(12) United States Patent
Zanghellini et al.

(10) Patent No.: US 11,060,119 B2
(45) Date of Patent: Jul. 13, 2021

(54) METHODS AND COMPOSITIONS FOR PREPARING TAGATOSE FROM FRUCTOSE

(71) Applicant: Arzeda Corp., Seattle, WA (US)

(72) Inventors: Alexandre Zanghellini, Seattle, WA (US); Kyle Roberts, Seattle, WA (US); Michael Charles Miller Cockrem, Madison, WI (US); Christopher Dunckley, Seattle, WA (US)

(73) Assignee: ARZEDA CORP., Seattle, WA (US)

( * ) Notice: Subject to any disclaimer, the term of this patent is extended or adjusted under 35 U.S.C. 154(b) by 0 days.

(21) Appl. No.: 16/503,092

(22) Filed: Jul. 3, 2019

(65) Prior Publication Data
US 2020/0165639 A1    May 28, 2020

Related U.S. Application Data

(60) Provisional application No. 62/693,681, filed on Jul. 3, 2018, provisional application No. 62/693,660, filed on Jul. 3, 2018.

(51) Int. Cl.
| | |
|---|---|
| *C12P 7/26* | (2006.01) |
| *C12N 15/113* | (2010.01) |
| *C12N 15/63* | (2006.01) |

(52) U.S. Cl.
CPC ............. *C12P 7/26* (2013.01); *C12N 15/113* (2013.01); *C12N 15/63* (2013.01)

(58) Field of Classification Search
CPC .. C12P 19/02; C12P 19/24; C12P 7/26; C12N 15/63; C12N 15/113; C12N 9/90
See application file for complete search history.

(56) References Cited

U.S. PATENT DOCUMENTS 10,138,506 B2 * 11/2018 Wichelecki ............. C12N 9/90

FOREIGN PATENT DOCUMENTS

| WO | WO 2017/059278 A1 | 4/2017 |
| WO | WO 2018/182345 A1 | 10/2018 |

OTHER PUBLICATIONS

Broun et al., Catalytic plasticity of fatty acid modification enzymes underlying chemical diversity of plant lipids. Science, 1998, vol. 282: 1315-1317. (Year: 1998).*
Devos et al., Practical limits of function prediction. Proteins: Structure, Function, and Genetics. 2000, vol. 41: 98-107. (Year: 2000).*
Lee et al., Structure-based prediction and indentification of 4-epimerization activity of phosphate sugars in class II aldolases. Nature, Scientific Reports, 2017, vol. 7: 1934, pp. 1-9. (Year: 2017).*
Seffernick et al., Melamine deaminase and Atrazine chlorohydrolase: 98 percent identical but functionally different. J. Bacteriol., 2001, vol. 183 (8): 2405-2410. (Year: 2001).*
Whisstock et al., Prediction of protein function from protein sequence. Q. Rev. Biophysics., 2003, vol. 36 (3): 307-340. (Year: 2003).*
Witkowski et al., Conversion of b-ketoacyl synthase to a Malonyl Decarboxylase by replacement of the active cysteine with glutamine. Biochemistry, 1999, vol. 38: 11643-11650. (Year: 1999).*
International Search Report and Written Opinion of the International Searching Authority for International Application No. PCT/US2019/040613, dated Nov. 22, 2019.
NCBI Reference Sequence: WP_012582774.1, class II D-tagatose-bisphosphate aldolase, non-catalytic subunit [Dictyoglomus turgidum], Apr. 27, 2020, 1 page.

* cited by examiner

*Primary Examiner* — Ganapathirama Raghu
(74) *Attorney, Agent, or Firm* — Cooley LLP

(57) ABSTRACT

Disclosed herein are compositions and methods for preparing tagatose from fructose, more particularly, compositions comprising thermophilic fructose C4-epimerases derived from thermophilic microorganisms and methods for preparing tagatose from fructose using the compositions.

52 Claims, 82 Drawing Sheets

Specification includes a Sequence Listing.

FIG. 17

| | |
|---|---|
| ACTIVE SITE MUTANT | |
| STABILITY/EXPR MUTANT | |
| LYS/CYS ONLY MUTANT | |
| LYS/CYS MUTANT | |
| pA06238 RESIDUE NUMBER | |
| SEQ_ID_NO_6_pA06238 | — — — — — — — — — — — — — — — — — — — — — — — — |
| SEQ_ID_NO_1_pA06233 | — — — — — — — — — — — — — — — — — — — — — — — — |
| SEQ_ID_NO_2_pA06234 | — — — — — — — — — — — — — — — — — — — — — — — — |
| SEQ_ID_NO_3_pA06235 | — — — — — — — — — — — — — — — — — — — — — — — — |
| SEQ_ID_NO_4_pA06236 | — — — — — — — — — — — — — — — — — — — — — — — — |
| SEQ_ID_NO_5_pA06237 | — — — — — — — — — — — — — — — — — — — — — — — — |
| SEQ_ID_NO_7_pA06239 | — — — — — — — — — — — — — — — — — — — — — — — — |
| SEQ_ID_NO_8_pA06240 | — — — — — — — — — — — — — — — — — — — — — — — — |
| SEQ_ID_NO_9_pA06241 | — — — — — — — — — — — — — — — — — — — — — — — — |
| SEQ_ID_NO_10_pA07068 | — — — — — — — — — — — — — — — — — — — — — — — — |
| SEQ_ID_NO_11_pA07069 | — — — — — — — — — — — — — — — — — — — — — — — — |
| SEQ_ID_NO_12_pA07070 | — — — — — — — — — — — — — — — — — — — — — — — — |
| SEQ_ID_NO_13_pA07071 | — — — — — — — — — — — — — — — — — — — — — — — — |
| SEQ_ID_NO_14_pA07072 | — — — — — — — — — — — — — — — — — — — — — — — — |
| SEQ_ID_NO_15_pA07073 | — — — — — — — — — — — — — — — — — — — — — — — — |
| SEQ_ID_NO_16_pA07074 | — — — — — — — — — — — — — — — — — — — — — — — — |
| SEQ_ID_NO_17_pA07075 | — — — — — — — — — — — — — — — — — — — — — — — — |
| SEQ_ID_NO_18_pA07076 | — — — — — — — — — — — — — — — — — — — — — — — — |
| SEQ_ID_NO_19_pA07077 | — — — — — — — — — — — — — — — — — — — — — — — — |
| SEQ_ID_NO_20_pA07078 | — — — — — — — — — — — — — — — — — — — — — — — — |
| SEQ_ID_NO_21_pA07079 | — — — — — — — — — — — — — — — — — — — — — — — — |
| SEQ_ID_NO_22_pA07080 | — — — — — — — — — — — — — — — — — — — — — — — — |
| SEQ_ID_NO_23_pA07081 | — — — — — — — — — — — — — — — — — — — — — — — — |
| SEQ_ID_NO_321_pA06242 | — — — — — — — — — — — — — — — — M - K L L E E F L K |
| SEQ_ID_NO_322_pA06243 | — — — — — — — — — — — — — — — — — — M F A E F Q H |
| SEQ_ID_NO_323_pA06244 | — — — — — — — — — — — — — — M A E - N I V E K F E K |
| SEQ_ID_NO_324_pA06245 | M V T V L Q T L L Q R P R P L A E I D R - T S L A R F L - |
| SEQ_ID_NO_325_pA06246 | — — — — — — — M D I Y E K — — — I - A A A L K D N R H N |
| SEQ_ID_NO_326_pA06247 | — — M E M Q K L Y E E V E N K N I V K N - D L V D L T I - |
| SEQ_ID_NO_327_pA06248 | — — — — — — — M K Q F L P — — — A - I E L L A K G E L P |
| SEQ_ID_NO_328_pA06249 | - M G N W K D F V K D F C T K E K N - I E V L - R A E A E |
| SEQ_ID_NO_329_pA06250 | — — — — M P S Q L P E P L P V P P E A R - A H — — — — — — |
| SEQ_ID_NO_330_pA06251 | — — — — — — — — — — — — — — — — — — M L K L L N E S |
| SEQ_ID_NO_331_pA06252 | — — — — — — — — — — — — — — — — — — — — — — — — |
| SEQ_ID_NO_332_pA06253 | — — — — — — — — — — — — — M M - L — — — S P E A L A E G |
| SEQ_ID_NO_333_pA06254 | — — — — — — — — — — — — — — — — — — M I G N V L S T |
| SEQ_ID_NO_334_pA06255 | — — — — — — — — — — — — — — — — — — — — — — — — |
| SEQ_ID_NO_335_pA06256 | — — — — — — — — — — — — — — — — — — — — — — — — |
| SEQ_ID_NO_336_pA06257 | — — — — — — — — — — — — — — — — — — — — — — — — |

FIG. 17 CONTINUED

ACTIVE SITE MUTANT
STABILITY/EXPR MUTANT
LYS/CYS ONLY MUTANT
LYS/CYS MUTANT pA06238 RESIDUE NUMBER

```
SEQ_ID_NO_337_pA06258    M V T V L Q T L L Q R P R P L A E I D R - A A L A R F L -
SEQ_ID_NO_338_pA06261    - - - - - - - - - - - - - - - - - - - - M L N L L E E L
SEQ_ID_NO_339_pA06262    - - - - - - - - - - - - - - - - - - - - M K E E L S D Y
SEQ_ID_NO_340_pA06263    - - - - - - - - - - - - - - - - M V E K S I L E K L T D F
SEQ_ID_NO_341_pA06264    - - - - - - - - - - - - - - - - M V E K G I L E K L T D F
SEQ_ID_NO_342_pA06265    - - - - - - - - - - - - - - - - - - - - - M I G N V L S T
SEQ_ID_NO_343_pA06266    - - - - - - - - - - - - - - - - - - - - - M I G N V L S T
SEQ_ID_NO_344_pA06267    - - - - - - - - - - - - - - - - - - - - - M I G N V L S T
SEQ_ID_NO_345_pA06268    - - - - - - - - - - - - - - - - - - - - - M I G N V L S T
SEQ_ID_NO_346_pA06269    - - - - - - - - - - - - - - - - - - - - - M V G N V S S V
SEQ_ID_NO_347_pA06270    - - - - - - - - - - - - - - - - - - - - - - - - - - - -
SEQ_ID_NO_348_pA06271    - - - - - - - - - - - - - - - - - - - - - M V G N V S A V
SEQ_ID_NO_349_pA06272    - - - - - - - - - - - - - - - - - - - - - - - - - - - -
SEQ_ID_NO_350_pA06273    - - - - - - - - - - - - - - - - - - - - - - - - - - - -
SEQ_ID_NO_351_pA06274    - - - - - - - - - - - - - - - - - - - - - - - - - - - -
SEQ_ID_NO_352_pA04536    - - - - - - - - - - - - - - - - - - - - - - M V L K V F K D
SEQ_ID_NO_353_pA04539    - - - - - - - - - - - - - - - - - - - - - M I N K V A E Y
SEQ_ID_NO_354_pA07082    - - - - - - - - - - - - - M K E N - K V M N S F S A
SEQ_ID_NO_355_pA07083    - - - - - - - - - - - - M Q S - R E E L - K R A I L
SEQ_ID_NO_356_pA07084    - - M S W K D F A E E L V G T S K E - - - - - A V M K V A
SEQ_ID_NO_357_pA07085    - - M S W K D F A E E L V G T S K E - - - - - A V M K V A
SEQ_ID_NO_358_pA07086    - - M S W K D F A E E L V G T S K D - - - - - A V K K V A
SEQ_ID_NO_359_pA07087    - - - - - - - M V K H F E S - - - V - L E E L S Q R K V P
SEQ_ID_NO_360_pA07088    - - - - - - - - - - - - - - - - - - - - - M I N K V A E Y
SEQ_ID_NO_361_pA07089    - - - - - - - - - - - - - - - - - - - - - - - - - - - -
SEQ_ID_NO_362_pA07090    - - - - - - - - - - - - - - - - - - - - - M I N K V A E Y
SEQ_ID_NO_363_pA07091    - - - - - - - - - - - - - - - - M F E R K I E M I N K V A E Y
SEQ_ID_NO_364_pA07092    - - - - - - - - - - - - - - - - M G M M D K D V L N Q L S S L
SEQ_ID_NO_365_pA07093    - - - - - - - - - - - - - - - - - - - - - M K E E L S N Y
SEQ_ID_NO_366_pA07094    - - M D L N G L L K D V E E - - - I - L A K V D A G E K V
SEQ_ID_NO_367_pA07095    - - - - - - - - - - - - - - - - - - - - - - - - - - - -
SEQ_ID_NO_368_pA07096    - - - - - - - - - - - - - - - - - - - - - - - - - - - -
SEQ_ID_NO_369_pA07097    - - - - - - - - - - - - - - - - - - - - - - - - - - - -
SEQ_ID_NO_370_pA07098    - - - - - - - - - - - - - - - - - - - - - - - - - - - -
SEQ_ID_NO_371_pA07099    - - - - - - - - - - - - - - - - - - - - - - - - - - - -
SEQ_ID_NO_372_pA07100    - - - - - - - - - - - - - - - - - - - - - - - - - - - -
SEQ_ID_NO_373_pA07101    - - - - - - - - - - - - - - - - - - - - - - - - - - - -
```

FIG. 17 CONTINUED

```
AS MUT
S/E MUT
L/C ONLY
L/C MUT
RESNUM

SEQ_6    ----------------------------------------
SEQ_1    ----------------------------------------
SEQ_2    ----------------------------------------
SEQ_3    ----------------------------------------
SEQ_4    ----------------------------------------
SEQ_5    ----------------------------------------
SEQ_7    ----------------------------------------
SEQ_8    ------------------------------------M Q A
SEQ_9    ----------------------------------------
SEQ_10   ----------------------------------------
SEQ_11   ----------------------------------------
SEQ_12   ----------------------------------------
SEQ_13   ----------------------------------------
SEQ_14   ----------------------------------------
SEQ_15   ----------------------------------------
SEQ_16   ----------------------------------------
SEQ_17   ----------------------------------------
SEQ_18   ----------------------------------------
SEQ_19   ------------------------------------M Q A
SEQ_20   ------------------------------------M Q A
SEQ_21   ----------------------------------------
SEQ_22   ----------------------------------------
SEQ_23   ----------------------------------------
SEQ_321  A F P G R F K V Y G S S L R I I T D S - Y F F L G N D G K E - - - - - K L
SEQ_322  L T R G K F V P Y A T S L R K S T D A - T F F L V R D E L D - - - - - K Y
SEQ_323  L F K G K Y K I Y Y S S I R K L E K S - F F F M I R D Q K Q - - - - - K Y
SEQ_324  T D V I R Q Q V Y P T S L E P T S E G - V F F L A R D G R E - - - - - K R
SEQ_325  I Q L D G V K I Y P Q S Y V E V D M V - K M I M V K A A E K - - - - - K V
SEQ_326  G E S L K I K A Y P L S V L K K D D A - F F F I G K E N Y D - - - - - K F
SEQ_327  S N S N Q I K V Y E K S Y T V E G N V - H L L M V K N S G E - - - - - K F
SEQ_328  K A F G N Y G V Y P R S I N E V G N A - I V M M A R G E N E - - - - - K C
SEQ_329  - - - - - - - - - P - S F R - L H E G - A A L W L A G A R L - - - - - A V
SEQ_330  L K P L S I F I Y S E S L R K I N D D L Y I F V A K I K D L - - - - - K K
SEQ_331  - - - - - - - - - - - - M N D A - V Y A L G R S S R N - - - - - G T
SEQ_332  L R L Y G L H L I V G S I R E L P D G G A I F A A R Q G S E - - - - - R R
SEQ_333  L E E N G F K V Y P D S L R K L G E N I Y I F V V K R Q N E - - - - - K M
SEQ_334  ----------------------------------------
SEQ_335  ----------------------------------------
SEQ_336  - - - - M L H V Y L G K I P R P G F G - - - - - - - - - - - - - - - -
```

FIG. 17 CONTINUED

```
AS MUT
S/E MUT
L/C ONLY
L/C MUT
RESNUM

SEQ_337  T D L I R Q Q V Y P A S L E P T S E G - V F F L A R D G R E - - - - - K R
SEQ_338  L K P F S I F V Y P Q S L R K I N E E L Y I F V A K I N N T - - - - - K N
SEQ_339  L L K N S F L L Y P D S F R R L R E D V Y I F V A K K D S D - - - - - K K
SEQ_340  L L N H S F V L Y P N S L R K L K E D T Y I F V A K K D A D - - - - - K K
SEQ_341  L L N H S F V L Y P N S L R K L K E D T Y I F V A K K D A D - - - - - K K
SEQ_342  L E E N G F K V Y P D S L R K L G E N I Y I F V V K R Q N E - - - - - K M
SEQ_343  L E E N G F K V Y P D S L R K L G E N I Y I F V V K R Q N E - - - - - K M
SEQ_344  L E E N G F K V Y P D S L M K L G E N I Y I F V V K R Q N E - - - - - K M
SEQ_345  L E E N G F K V Y P D S L R K L G E N I Y I F V V K R Q N E - - - - - K M
SEQ_346  L K E S G F Q I Y P D S L R K L G E N T Y I F V V K K Q E - - - - - K M
SEQ_347  - - - - - - - - - - - - - - - - - - - - - - - - - - - - - - - - - - - -
SEQ_348  L K E N G F K I Y P D S L R K L G E S T Y I F V V K K Q K E - - - - - K M
SEQ_349  - - - - - - - - - - - - - - - - - - - - - - - - - - - - - - - - - - - -
SEQ_350  - - - - - - - - - - - - - - - - - - - - - - - - - - - - - - - - - - - -
SEQ_351  - - - - - - - - - - - - - - - - - - - - - - - - - - - - - - - - - - - -
SEQ_352  H F G R G Y E V Y E K S Y R E K D S L - S F F L T K E E E G - - - - - K I
SEQ_353  L S G E G F Y F Y E K S F R K L S E D I Y I F V V K K A N E - - - - - K S
SEQ_354  I Y G N R Y K V Y E K S L R K E K E - F F F V I K D F Q R - - - - - K Y
SEQ_355  S E F G D Y N I Y S E S I Y R A G G C - V L F L A K D M G Q - - - - - K L
SEQ_356  E Y A E D Y R I Y P R S I I K K D K S - F Y F L A K I D Q K - - - - - K K
SEQ_357  E Y A E D Y R I Y P R S I I K K D K S - F Y F L A K I D Q K - - - - - K K
SEQ_358  E Y A E D Y R I Y P R S I I K K E K S - F Y F L A K I D Q K - - - - - K K
SEQ_359  T S T E E V T V Y T P S F E E H A G S - Q V V M V K S G T E - - - - - K M
SEQ_360  L S R E G F H F Y E K S F R K F S E D I Y I F V V K K A N E - - - - - K S
SEQ_361  - - - - - - - - - - - - - - - - - - - - - - - - - - - - - - - - - - - -
SEQ_362  L S R E G F Y F Y E K S F R K F S E D I Y I F V V K K A N E - - - - - K S
SEQ_363  L S R E G F Y F Y E K S F R K F S E D I Y I F V V K K A N E - - - - - K S
SEQ_364  L S R H S F V L Y P N S V R N L A E D I Y V F V A K G N A D - - - - - K K
SEQ_365  L L K N S F L L Y P D S F R R L K E D V Y I F V A K K D S D - - - - - K K
SEQ_366  E S L S D A G V Y V P S V Q V D R R N - V Y F I Y H T K D E K D H T V K T
SEQ_367  - - - - - - - - - - - - - - - - - - - - - - - - - - - - - - - - - - - -
SEQ_368  - - - - - - - - - - - - - - - - - - - - - - - - - - - - - - - - - - - -
SEQ_369  - - - - - - - - - - - - - - - - - - - - - - - - - - - - - - - - - - - -
SEQ_370  - - - - - - - - - - - - - - - - - - - - - - - - - - - - - - - - - - - -
SEQ_371  - - - - - - - - - - - - - - - - - - - - - - - - - - - - - - - - - - - -
SEQ_372  - - - - - - - - - - - - - - - - - - - - - - - - - - - - - - - - - - - -
SEQ_373  - - M L D T P R Y L G K L P H L S V G - - - - - - - - - - - - - - - - - -
```

FIG. 17 CONTINUED

```
AS MUT
S/E MUT
L/C ONLY
L/C MUT
RESNUM

SEQ_6    ------------------------------------
SEQ_1    ------------------------------------
SEQ_2    ------------------------------------
SEQ_3    ------------------------------------
SEQ_4    ------------------------------------
SEQ_5    ------------------------------------
SEQ_7    --------MSTLRHIIL-------------------
SEQ_8    QALLTVPFDRVATHARGFVG----------------
SEQ_9    --MTDEDFEPICEISEQFRN--------------YC
SEQ_10   ------------------------------------
SEQ_11   ------------------------------------
SEQ_12   ------------------------------------
SEQ_13   ------------------------------------
SEQ_14   ------------------------------------
SEQ_15   ------------------------------------
SEQ_16   ------------------------------------
SEQ_17   ------------------------------------
SEQ_18   ------------------------------------
SEQ_19   QALLTVPFDRVATHARGFVG----------------
SEQ_20   HVLLAPSFEQLADHRHGFVG----------------
SEQ_21   --------MAKIP-IQSA------------------
SEQ_22   --------MKKIS-IFEI------------------
SEQ_23   ------------------------------------
SEQ_321  LFVVG--KKGICQLFDGQK------IGQIGSNDVLMC
SEQ_322  LIVIG--KKGICELFEGQK------IGEIDRQDVVLC
SEQ_323  LISIA--KKRICEKFEGKK------IGRINDLDILMC
SEQ_324  LGILS--EA----GLHDFEGVRHQLSLDGRTLIFQSC
SEQ_325  ILAQG--SGP---LFQELEGEAY-----D---DYKVC
SEQ_326  LFVIS--AGKENGLLNEFEGELI---DAGKDVTVKKC
SEQ_327  ILATG--EGA---IFDELTGTDV---DG---KGKAC
SEQ_328  LVVVG--EDS---RLQELKGNQT----EENGLKVKVC
SEQ_329  LAPPE--HP----ALTRFRGEVQ---HVGDHR-LLRA
SEQ_330  IGIVK--QNQILYFSSPYFSEDKK--IEGTNFLVNLY
SEQ_331  LQLIV--RG----NSTGFHGEQQ-----G---DALIC
SEQ_332  IGWIG--ETSPFPAPDPRMSMR-------VQEHLVWIH
SEQ_333  VGILS--SSD-VKLNGAYFSEDKN--VSD-KLRLNIY
SEQ_334  ------------------------------------
SEQ_335  ------------------------------------
SEQ_336  -IRIP--EVVAPPLLSAFKSLGM-----T-GSLM---
```

FIG. 17 CONTINUED

```
AS MUT   ┌┬┬┬┬┬┬┬┬┬┬┬┬┬┬┬┬┬┬┬┬┬┬┬┬┬┬┬┬┬┬┬┬┬┬┐
S/E MUT  ├┼┼┼┼┼┼┼┼┼┼┼┼┼┼┼┼┼┼┼┼┼┼┼┼┼┼┼┼┼┼┼┼┼┼┼┤
L/C ONLY ├┼┼┼┼┼┼┼┼┼┼┼┼┼┼┼┼┼┼┼┼┼┼┼┼┼┼┼┼┼┼┼┼┼┼┼┤
L/C MUT  └┴┴┴┴┴┴┴┴┴┴┴┴┴┴┴┴┴┴┴┴┴┴┴┴┴┴┴┴┴┴┴┴┴┴┴┘
RESNUM
SEQ_337 L G I L S - - E A - - - - G L H D F E G A R H Q L S L D G R T L I F Q S C
SEQ_338 I G I I K - - Q N Q S I Y F S N P Y F S E D K K - - I E K T G F S V N I Y
SEQ_339 I G L L T - - N G N - F K L S S P H F A E D K Y - - V E E L G F Y I N L Y
SEQ_340 I G I L T - - K E N - F K L T S P Y F V E D K N - - V K E I D F Y L N L Y
SEQ_341 I G I L T - - K E N - F K L S S P Y F V E D K N - - V K E I D F Y L N L Y
SEQ_342 V G I L S - - S S D - V K L N G A Y F S E D K N - - V S D - K L R L N I Y
SEQ_343 V G I L S - - S S D - V K L N G A Y F S E D K N - - V S D - K L R L N I Y
SEQ_344 V G I L S - - S S D - V K L N G A Y F S E D K N - - V S D - K L R L N I Y
SEQ_345 V G I L S - - S S D - V K L N G A Y F S E D K N - - V S D - K L R L N I Y
SEQ_346 I G I L S - - N D E - L K L K E P Y F S E N K K - - I S D - N L Q F N V Y
SEQ_347 - - - - - - - - - - - - - - - - - - - - - - - - - - - - - - - - - - - -
SEQ_348 I G I L S - - N D E - L N L K E P Y F S E N K K - - I S D - N L Q F N V Y
SEQ_349 - - - - - - - - - - - - - - - - - - - - - - - - - - - - - - - - - - - -
SEQ_350 - - - - - - - - - - - - - - - - - - - - - - - - - - - - - - - - - - - -
SEQ_351 - - - - - - - - - - - - - - - - - - - - - - - - - - - - - - - - - - - -
SEQ_352 L V V A G - - E K A P E G L - S F F K - - - - - - K Q R A E G V S F F F C
SEQ_353 I G L L T - - Q G D - F T L S S P H F T E R K Y - - L K E T G Y Y L N L Y
SEQ_354 L V A A G - - P S Y R I R K R D F Q P D E E G - V A D N E G E F L F Q I C
SEQ_355 L V V E E E T G S - - - A F D R F V G P Q V - - - Y H P S G K R V K E A
SEQ_356 L V I L N - - K S K - - - N F E L F Q G R I E - - - - E L A G F K A K I G
SEQ_357 L V I L N - - K S K - - - N F E L F Q G R I E - - - - E L A G F K A K I G
SEQ_358 L V I L N - - K S K - - - N F D I F Q G K T E - - - - K L A G F K A K I A
SEQ_359 I V A A G - - A G E - - - L F E A L S G E D I - - - - - G - - - K G K V C
SEQ_360 I G L L T - - Q R D - F T L S S P Y F T E R K Y - - L K E I G Y Y L N L Y
SEQ_361 - - - - - - - - - - - - - - - - - - - - - - - - - - - - - - - - - - - -
SEQ_362 I G L L T - - Q G D - F T L S S P Y F T E R K Y - - L K E I G Y Y L N L Y
SEQ_363 I G L L T - - Q G D - F T L S S P Y F T E R K Y - - L K E I G Y Y L N L Y
SEQ_364 V G I L S - - K G K A L G F K A P F F A E D I K - - V E A T G F S F N L Y
SEQ_365 I G F L T - - N G N - F K L S S P H F L E D K Y - - V E E L G F Y L N L Y
SEQ_366 L V V Y E - - E N P - - - T I G D F D A L E T - - - L K G E N S T L I T A
SEQ_367 - - - - - - - - - - - - - - - - - - - - - - - - - - - - - - - - - - - -
SEQ_368 - - - - - - - - - - - - - - - - - - - - - - - - - - - - - - - - - - - -
SEQ_369 - - - - - - - - - - - - - - - - - - - - - - - - - - - - - - - - - - - -
SEQ_370 - - - - - - - - - - - - - - - - - - - - - - - - - - - - - - - - - - - -
SEQ_371 - - - - - - - - - - - - - - - - - - - - - - - - - - - - - - - - - - - -
SEQ_372 - - - - - - - - - - - - - - - - - - - - - - - - - - - - - - - - - - - -
SEQ_373 - V R L P - - E V F L E G I M S G F K T G N S - - - - - A - G G V M - - -
```

FIG. 17 CONTINUED

```
AS MUT
S/E MUT
L/C ONLY
L/C MUT
RESNUM              1 2 3       4                           5 6 7 8 9 10 11 12 13 14 15   16 17 18

SEQ_6    - - - M W L - - S - - - - - - - - - - - - K D Y L R K K G V Y S - I C S
SEQ_1    - - - - - M - - S L H P L N K L I E - R - - H K K G T P V G I Y S - V C S
SEQ_2    - - M M F G - - S P A P L L D M V T - A - - Q K Q G M A R G I P S - I C S
SEQ_3    - - - - M A - - K E H P L K E L V N - K - - Q K S G I S E G I V S - I C S
SEQ_4    - - - - M N - - T E H P L K N V V K - L - - Q K K G I P I G I Y S - V C S
SEQ_5    - - - - M S - - P Q N P L I G L F K - N - - - R E K E F K G I I S - V C S
SEQ_7    - - - - - - - - - - R L - I E L - R - - E R E Q I H L T L L A - V C P
SEQ_8    - - - - - - - - - - W V A E L L - Q - - G P L A Y Q H T L L A - V C P
SEQ_9    N Q M L E S E Y D P K P S K Y I F N - I - - - L Q N Q K T I V M A - A N P
SEQ_10   - - - - M N - - T E H P L K N V V K - L - - Q K K G I P I G I Y S - V C S
SEQ_11   - - - - - M - - Q R N Y L L D I V E - A - - Q N N G I H K G I Y S - A C S
SEQ_12   - - - - - M - - K K H P L Q D I V S - L - - Q K Q G I P K G V F S - V C S
SEQ_13   - - - - - M - - N H N P L K K I V E - L - - Q K Q G K N V G I Y S - V C S
SEQ_14   - M L L K V - - K E H P I R E L V N - R - - Y K N G E N V G I F S - V C T
SEQ_15   - - - - - - - - M Y P V L E N I L R - A - - Q Q Q G E A L G I P S - I C S
SEQ_16   - - - M E R - - K V K H L T H M V E - Q - - H K R G N A N G I Y A - V C S
SEQ_17   - - - M W L - - D - - - - - - - - - - - - S N F L K N R G I F S - I C S
SEQ_18   - - - M W L - - S - - - - - - - - - - - - K D Y L R K K G V Y S - I C S
SEQ_19   - - - - - - - - - - W V A E L L - L - - G P L A H Q H T L L A - V C P
SEQ_20   - - - - - - - - - - W L V D L L - R - - G P L A Y R H T L L A - V C P
SEQ_21   - - - - - - - - - - V K A L L E - L - - Q D E G K G G T L L G - I G P
SEQ_22   - - - - - - - - - - V K A S L N - M - - K G K - D K A T L L G - I G P
SEQ_23   - - M T D T N Y K A K P G S L L F E - S - - - L M D K E T I I L A - I N P
SEQ_321  K K T - H E - - N L L A L R K - I I N L N P T T I N K - K A S F G - F G D
SEQ_322  A K N - D R - - N C Q S L M S L F P S L K P Q I C N A - K L S F G - F G D
SEQ_323  P T N - D Y - - N C K V I R T - L F N I N P S V C K K - N T S F G - F G D
SEQ_324  P L T - A A - - N A R A L R R H I P W T A P R P L G L - R A S V G - C G D
SEQ_325  N C S - H L - - N R V V L N K Y L P Y T K P S A F G K E I A T I G - L G D
SEQ_326  N L S - T K - - N R K A V Q K I F P H T A P I V L G L - C N S F G - C G D
SEQ_327  P L T - Y E - - N R L V L N K Y F D Y T V P Q A F G T E I A T I G - L G D
SEQ_328  P L S - N E - - N C Y V I R K I F P Y T N P Q P H K G K N I T I G - L G D
SEQ_329  E R R - A E - - N A A A L R A L L P D L Q P R P L G L - V T S A G - F G D
SEQ_330  P L N - F E - - N Y Q K L K E I I P - I S P K V C D K - K I S F G - T G D
SEQ_331  P L D - A E - - N A R T L Q E R L P W L R P Q P L G N - R L S F G - F G D
SEQ_332  P W T - W A - - H Y R I L R E R L P A L S P T R C D R - P A S F G - A G D
SEQ_333  P F T - F E - - N Y V T L N G K F H - I G P T V C R G - N S S F G - T G D
SEQ_334  - - - - - - - - - - - - - - - - - - - - M F T I L P K K G I S L G - L G D
SEQ_335  - - - - - - - - - - - - - - - - - - - M A T P G S L S F P R Y S I G - T G D
SEQ_336  - L S - F N - - - R E T A P A E Y I E S S D P - R L - - - F Y F G H T G T
```

FIG. 17 CONTINUED

```
AS MUT
S/E MUT
L/C ONLY
L/C MUT
RESNUM                        1 2 3       4                       5 6 7 8 9 10 11 12 13 14 15   16 17 18
SEQ_337  P L T - A A - - N A R A L R Q H L A W T A P R P L G L - R A S V G - C G D
SEQ_338  P L N - F E - - N Y Q K L K E I I P - I N P K T C N K - K I S F G - T G D
SEQ_339  P L T - Y E - - N Y L I L K D N F G - I S P V T C K E - K A S F G - T G D
SEQ_340  P L S - F E - - N Y L I L K - N F G - I S P T P C R Q - K S S F G - T G D
SEQ_341  P L S - F E - - N Y L I L K - N F G - I S P T P C R Q - K S S F G - T G D
SEQ_342  P F T - F E - - N Y V T L N G K F H - I G P T V C R G - N S S F G - T G D
SEQ_343  P F T - F E - - N Y V T L N G K F H - I G P T V C R G - N S S F G - T G D
SEQ_344  P F T - F A - - N Y V T L N G K F H - I G P T V C R G - N S S F G - T G D
SEQ_345  P F T - F E - - N Y V T L N G K F H - I G P T V C R G - N S S F G - T G D
SEQ_346  S F T - F D - - N Y V T L N G R F H - I G P T I C R E - N A S F G - T G D
SEQ_347  - - - - - - - - - - - - - - - - - - - - M L T I L P N K G I S L G - L G D
SEQ_348  P F T - F D - - N Y V T L N G R F H - I G P T V C R E - N A S F G - T G D
SEQ_349  - - - - - - - - - - - - - - - - - - - - M F T I L P K R G I S L G - L G D
SEQ_350  - - - - - - - - - - - - - - - - - - - - M T T P G S L S L P R Y S I G - T G D
SEQ_351  - - - - - - - - - - - - - - - - - - - - - - - - - - - - - - - - - - - - - -
SEQ_352  E R N - H E - - N L E V L R K Y F P D L K P V R A G L - R A S F G - T G D
SEQ_353  P L T - Y E - - N F V I L K D K F N - I A P A P C D K - K A S F G - M G D
SEQ_354  R L T - H H - - N L T Q L Q S I F N Y L Q P S T T K M - K P S F G - T G D
SEQ_355  P L Q - P V - - N A G I V R E L L P F T A P V A L G A T G L S L G - L G D
SEQ_356  P L S - H Y - - N A E I L R E V F P F T A P S A L G N K K P S I G - L G D
SEQ_357  P L S - H Y - - N A E I L R K V F P F T A P S A L G N K K P S I G - L G D
SEQ_358  P L S - H Y - - N A E I I R E V F P F T A P S K I G N Q T A S I G - L G D
SEQ_359  P L T - H E - - N R L V L N Q F F S Y T A P Q A F G T D I A T M G - L G D
SEQ_360  P L T - Y E - - N F V I L K D K F S - I A P S P C N K - K V S F G - M G D
SEQ_361  - - - - - - - - - - - - - - - - - - - M L P Y L V A R P L G L - R K S A G - C G D
SEQ_362  P L T - Y E - - N F V I L K D K F S - I A P S P C N K - K V S F G - M G D
SEQ_363  P L T - Y E - - N F V I L K D K F S - I A P S P C N K - K V S F G - M G D
SEQ_364  P L S - F E - - N Y L I L R D E F G - I A L V P C K N - K A S F G - T G D
SEQ_365  P L T - Y E - - N Y L I L K D N F G - I S P V T C K E - K T S F G - T G D
SEQ_366  A L T - D H - - N N Q A L A K R F P W I K P T S R R N Y K Y T F G - L G D
SEQ_367  - - - - - - - - - - - - - - - - - - - - M F T I L P K K G I S L G - L G D
SEQ_368  - - - - - - - - - - - - - - - - - - - - M F S K L P K Q G I S L G - L G D
SEQ_369  - - - - - - - - - - - - - - - - - - - - M F T I L P K K G I S L G - L G D
SEQ_370  - - - - - - - - - - - - - - - - - - - - M F T I L P K K G I S I G - L G D
SEQ_371  - - - - - - - - - - - - - - - - - - - - - - - - - - M K K L A K Y S F G - M G D
SEQ_372  - - - - - - - - - - - - - - - - - - - - - - - - - - M K Q L E R F S M G - I G D
SEQ_373  - L S - Y H - - - R E T A P E Y V I N A P P G D F E - - - L T R G H T G T
```

FIG. 17 CONTINUED

```
AS MUT
S/E MUT
L/C ONLY
L/C MUT
RESNUM    19 20           21 22 23 24 25 26 27 28 29   30 31 32 33 34 35 36 37 38 39 40 41 42        43 44 45
SEQ_6     S N - - - - S Y V I E A S I E - F A K E K G D Y I L I E A - - - - - T P H
SEQ_1     A N - - - - P F V L K A A M L - Q A Q K D Q S L L L I E A - - - - - T S N
SEQ_2     A H - - - - P V V L S A A C H - L A R R S G A P L L I E T - - - - - T C N
SEQ_3     S N - - - - E F V I E A S M E - R A L T N G D Y V L I E S - - - - - T A N
SEQ_4     A N - - - - E I V I Q V A M E - K A L S M D S Y V L I E A - - - - - T A N
SEQ_5     S N - - - - E I V L E A V L K - R M K D T N L P I I I E A - - - - - T A N
SEQ_7     N S - - - - A A V L E A A V K - V A A R C H T P M L F A A - - - - - T L N
SEQ_8     N S - - - - E A V T R A A L E - A A A E A N A P L L F A A - - - - - T L N
SEQ_9     R I - - - - G L V T R G I L R - A A K D A D A P I I L E L - - - - - A R S
SEQ_10    A N - - - - E I V I Q V A M E - K A L S M D S Y V L I E A - - - - - T A N
SEQ_11    A N - - - - E Y V I E A A M E - R A K N T N E Y V L I E A - - - - - T A N
SEQ_12    A N - - - - R F V I E T T L E - Y A K M G T T V L I E A - - - - - T C N
SEQ_13    A N - - - - G Y V I E A A L K - R G K S D G S C V L I E S - - - - - T A N
SEQ_14    S N - - - - E Y V I E A A M E - R V I D K D L D L L I E S - - - - - T A N
SEQ_15    A H - - - - P F V L E A T F R - H A L T T G R T V L I E S - - - - - T C N
SEQ_16    A H - - - - P L V L E A A I R - Y A Q S H Q T P L L I E A - - - - - T S N
SEQ_17    S N - - - - E N V L D A S I E - F A K E K E D F L L I E A - - - - - T C H
SEQ_18    S N - - - - P Y V I E A S V E - F A K E K N D Y I L I E A - - - - - T P H
SEQ_19    N S - - - - E A V T R A A L E - A A A E V N A P L L F A A - - - - - T L N
SEQ_20    N S - - - - E A V T R A A L E - A A R E A N A P L F F A A - - - - - T L N
SEQ_21    M S - - - - T N V L Q A S F E - L A R D Y D F P L M F I A - - - - - S R N
SEQ_22    M S - - - - K T L I K A S M I - L A K E K D F P L M F I A - - - - - S R N
SEQ_23    R I - - - - S L L N K G I L K - A A K D M D A P I I L E L - - - - - A K S
SEQ_321   R I G L A T P A H A K V A K D - - - - - - F E V - - - - - - F P I F A Q
SEQ_322   R L G V A T A A H A Q C V Q K - - - - - - E K L - - - - - - F P I F A Q
SEQ_323   R L G L A T P A H T T L I N K - - - - - - Y D V - - - - - - F P V L A Q
SEQ_324   R L G L A T P G H V R A V R K - - - - - - H K L - - - - - - A P V F A Q
SEQ_325   R L G I A S P G H I Q A V K G - - - - - - R E I - - - - - - R P I L A Q
SEQ_326   R L G V A N A G H I R A I K Q - - - - - - S N F - - - - - - R P I L A Q
SEQ_327   R L G L A S P G H I E T V R E - - - - - - K N I - - - - - - K P V L A Q
SEQ_328   R L G L A S P G H I R L I R D - - - - - - L D V - - - - - - F P V L A Q
SEQ_329   R L G V A T P G H V R A A Q R - - - - - Y G A G V - - - - - - A P V F A Q
SEQ_330   R L G L I T S A Q L S A L K E - - - - - - Y D L - - - - - - F P I L A Q
SEQ_331   R I G L A T P G H V D A L R S - - - A D P T G R I - - - - - - A P I F A Q
SEQ_332   R L G M A T A A Q I A A L E R - - - - - - Y P V - - - - - - F P V L A Q
SEQ_333   R L G L V T A A Q L T A L K K - - - - - - Y D V - - - - - - F P I L A Q
SEQ_334   R I G I A T P G H I K V A K K - - - - - - Y N F - - - - - - F P V F A Q
SEQ_335   R F G H E A E A Q L R A V I E - - A G R L G R A L - - - - - - G I V W - N
SEQ_336   S I - - - - G G F I R S V K E - Y S K A L S V P V E V E A D H V S I L - G
```

FIG. 17 CONTINUED

```
RESNUM       19 20  21 22 23 24 25 26 27 28 29  30 31 32 33 34 35 36 37  38 39 40 41 42  43 44 45
SEQ_337   R  L  G  L  A  T  P  G  H  V  R  A  V  R  K  -  -  -  -  -  -  -  H  K  L  -  -  -  -  -  -  A  P  V  F  A  Q
SEQ_338   R  L  G  L  V  T  S  A  Q  L  S  V  L  K  D  -  -  -  -  -  -  -  Y  N  L  -  -  -  -  -  -  F  P  I  L  A  Q
SEQ_339   R  L  G  L  A  T  P  A  H  I  K  A  L  K  N  -  -  -  -  -  -  -  Y  N  V  -  -  -  -  -  -  F  P  V  L  A  Q
SEQ_340   R  L  G  L  V  T  P  A  H  I  V  A  L  K  E  -  -  -  -  -  -  -  Y  P  V  -  -  -  -  -  -  F  P  V  L  A  Q
SEQ_341   R  L  G  L  V  T  P  A  H  I  V  A  L  K  E  -  -  -  -  -  -  -  Y  P  V  -  -  -  -  -  -  F  P  V  L  V  Q
SEQ_342   R  L  G  L  V  T  A  A  Q  L  T  A  L  K  K  -  -  -  -  -  -  -  Y  D  V  -  -  -  -  -  -  F  P  I  L  A  Q
SEQ_343   R  L  G  L  V  T  A  A  Q  L  T  A  L  K  K  -  -  -  -  -  -  -  Y  D  V  -  -  -  -  -  -  F  P  I  L  A  Q
SEQ_344   R  L  G  L  V  T  A  A  Q  L  T  A  L  K  K  -  -  -  -  -  -  -  Y  D  V  -  -  -  -  -  -  F  P  I  L  A  Q
SEQ_345   R  L  G  L  V  T  A  A  Q  L  T  A  L  K  K  -  -  -  -  -  -  -  Y  D  V  -  -  -  -  -  -  F  P  I  L  A  Q
SEQ_346   R  L  G  L  A  T  A  A  Q  L  D  A  L  K  K  -  -  -  -  -  -  -  F  N  V  -  -  -  -  -  -  F  P  I  L  A  Q
SEQ_347   R  I  G  I  A  T  H  G  H  I  K  V  A  K  K  -  -  -  -  -  -  -  Y  N  F  -  -  -  -  -  -  F  P  V  F  A  Q
SEQ_348   R  L  G  M  A  T  A  A  Q  L  G  A  L  K  K  -  -  -  -  -  -  -  F  D  V  -  -  -  -  -  -  F  P  V  L  A  Q
SEQ_349   R  I  G  I  A  T  T  G  H  I  K  V  A  K  K  -  -  -  -  -  -  -  Y  N  F  -  -  -  -  -  -  F  P  V  F  A  Q
SEQ_350   R  F  G  H  E  A  E  A  Q  L  R  A  V  I  E  -  -  A  E  R  L  G  M  A  L  -  -  -  -  -  -  G  I  V  W  -  N
SEQ_351   -  -  -  -  -  -  -  -  -  -  -  -  -  -  -  -  -  -  -  -  -  -  -  -  -  -  -  -  -  -  -  -  -  -  -  -  -
SEQ_352   R  L  G  I  T  T  P  A  H  V  R  A  L  K  D  -  -  -  -  -  -  -  S  G  L  -  -  -  -  -  -  F  P  I  F  A  Q
SEQ_353   R  L  G  L  V  T  A  A  H  I  R  A  V  E  N  -  -  -  -  -  -  -  Y  D  V  -  -  -  -  -  -  F  P  V  L  A  Q
SEQ_354   R  L  G  I  A  T  P  A  H  I  Q  A  F  E  D  -  -  -  -  -  -  -  K  N  I  -  -  -  -  -  -  F  P  I  L  A  Q
SEQ_355   R  L  G  V  A  S  P  G  H  L  R  L  I  K  K  -  -  -  -  -  -  -  T  G  V  -  -  -  -  -  -  R  P  V  L  A  Q
SEQ_356   R  L  G  I  A  T  P  G  H  I  E  A  V  K  E  -  -  -  -  -  -  -  S  A  A  -  -  -  -  -  -  M  P  V  F  A  Q
SEQ_357   R  L  G  I  A  T  P  G  H  I  E  A  V  K  E  -  -  -  -  -  -  -  S  A  A  -  -  -  -  -  -  M  P  V  F  A  Q
SEQ_358   R  L  G  I  A  T  P  G  H  I  E  A  V  K  K  -  -  -  -  -  -  -  S  N  A  -  -  -  -  -  -  M  P  V  F  A  Q
SEQ_359   R  L  G  I  A  S  P  G  H  I  D  T  V  K  E  -  -  -  -  -  -  -  R  N  V  -  -  -  -  -  -  K  P  I  L  A  Q
SEQ_360   R  L  G  L  V  T  A  A  H  I  R  A  V  Q  N  -  -  -  -  -  -  -  Y  D  V  -  -  -  -  -  -  F  P  V  L  A  Q
SEQ_361   R  L  G  L  A  T  P  G  H  I  R  A  L  R  A  T  F  G  R  D  E  D  A  A  M  -  -  -  -  -  -  A  P  I  F  A  Q
SEQ_362   R  L  G  L  V  T  A  A  H  I  R  A  V  E  N  -  -  -  -  -  -  -  Y  D  V  -  -  -  -  -  -  F  P  V  L  A  Q
SEQ_363   R  L  G  L  V  T  A  A  H  I  R  A  V  E  N  -  -  -  -  -  -  -  Y  D  V  -  -  -  -  -  -  F  P  V  L  A  Q
SEQ_364   R  L  G  L  A  T  P  A  H  L  D  A  F  K  S  -  -  -  -  -  -  -  Y  N  M  -  -  -  -  -  -  F  P  V  L  A  Q
SEQ_365   R  L  G  L  V  T  P  A  H  I  K  V  L  K  N  -  -  -  -  -  -  -  Y  D  I  -  -  -  -  -  -  F  P  V  L  A  Q
SEQ_366   R  L  G  N  A  S  N  A  H  L  R  L  F  K  G  -  -  -  -  -  -  -  T  G  I  -  -  -  -  -  -  M  P  V  L  A  Q
SEQ_367   R  I  G  I  A  T  T  G  H  I  K  V  A  K  K  -  -  -  -  -  -  -  Y  N  F  -  -  -  -  -  -  F  P  V  F  A  Q
SEQ_368   R  V  G  L  A  T  P  G  H  I  K  V  A  K  R  -  -  -  -  -  -  -  H  E  F  -  -  -  -  -  -  F  P  V  F  A  Q
SEQ_369   R  I  G  I  A  T  P  G  H  I  K  V  A  K  K  -  -  -  -  -  -  -  Y  N  F  -  -  -  -  -  -  F  P  V  F  A  Q
SEQ_370   R  I  G  I  A  T  P  G  H  I  K  V  A  K  K  -  -  -  -  -  -  -  Y  N  F  -  -  -  -  -  -  F  P  V  F  A  Q
SEQ_371   R  F  A  H  Q  A  S  W  Q  L  K  A  I  T  E  -  -  I  E  K  Q  G  I  E  V  -  -  -  -  -  -  T  P  V  W  -  N
SEQ_372   R  F  G  H  Q  G  K  A  Q  L  E  A  L  A  E  -  -  A  K  H  L  G  C  T  I  -  -  -  -  -  -  I  P  V  W  -  N
SEQ_373   S  I  -  -  -  -  -  R  H  Y  I  E  A  S  V  A  -  K  A  K  E  K  G  V  V  V  E  V  E  A  D  H  V  S  V  S  -  V
```

FIG. 17 CONTINUED

```
          AS MUT  ■                      ■
          S/E MUT          ■      ■ ■■ ■■■■  ■■ ■■
          L/C ONLY         ■ ■■  ■■■ ■■ ■  ■■■ ■■■
          L/C MUT     ■      ■ ■
          RESNUM  4444455555555556666666666777777777
                  6789012345678901234567890123456788

SEQ_6    Q V N Q F - - - G G Y - S G M T P E D F K N F V M K I A K E K G L E E D K
SEQ_1    Q V D Q F - - - G G Y - T G M R P E D F K T M T L E L A A E N N Y D P Q G
SEQ_2    Q V N H Q - - - G G Y - S G M T P A D F V R F L R E I L E R E G I P P Q Q
SEQ_3    Q V N Q Y - - - G G Y - I G M T P I E F K K F V F S I A K K V D F P L D K
SEQ_4    Q V N Q Y - - - G G Y - T N M K P I D F R D F V Y S I A K R I N F P E N R
SEQ_5    Q V N Q F - - - G G Y - S G L T P S Q F K E R V I K I A Q K V D F P L E R
SEQ_7    Q V D R D - - - G G Y - T G W T P A Q F V A E M R R Y A V R Y G C T T - P
SEQ_8    Q V D L D - - - G G Y - T G W T P A T L A R F V A D E L A R L D L H I - P
SEQ_9    E C N L E - - - N G Y - T G L Y P S D F S E Q C Y Q A A K D V G Y D I - -
SEQ_10   Q V N Q Y - - - G G Y - T N M K P I D F R D F V Y S I A K R I N F P E N R
SEQ_11   Q V N Q Y - - - G G Y - T G M K P I D F K N F V Y D I A D K I N F D K D K
SEQ_12   Q V N Q F - - - G G Y - T G M T P A D F R E M V F S I A E D I G L P K N K
SEQ_13   Q C D Q N - - - G G Y - T G M T P L D F K N F V L G I A D K V G F D P K R
SEQ_14   Q V N Q D - - - G G Y - T G M Q P K D F V N Y V Y K I A D K V N F P K D R
SEQ_15   Q V N Q H - - - G G Y - T G M T P G D F V A Y V A A L A D R L H F P R E R
SEQ_16   Q V D Q F - - - G G Y - T G M T P E D F Y G F V C C L A E S L D F P T S Q
SEQ_17   Q V N Q F - - - G G Y - T K M T P E S F S K K I F K K A E E M N F N P E R
SEQ_18   Q I N Q F - - - G G Y - S G M T P E D F K N F V M G I I K E K G I E E D R
SEQ_19   Q V D L D - - - G G Y - T G W T P A T L A R F V A D E L A R L D L H I - P
SEQ_20   Q V D L D - - - G G Y - T G W T P A T L A R F V A D E R I R L G L R A - P
SEQ_21   Q V D L D E L G G G Y V N G W N Q Y T F V Q A I R E M A E L T G F D G - L
SEQ_22   Q V D L K E L G G G Y V C N W D Q K S F A S D I K K I A E E V G F N G - L
SEQ_23   E C N L E - - - G G Y - T G F T P S E F S K R A Y E S A E E I G I D I - -
SEQ_321  Q S V R E - - - L S R - T G R T Y K D V L D D A V W G V F E S G Y N F - E
SEQ_322  Q S V R E - - - I S R - T E R N W L D V L H S A V W G V F E S G Y D G - P
SEQ_323  Q S V R E - - - L S R - T H R N F K D V L D S A I W G I F E S G Y E G - E
SEQ_324  Q S I R E - - - M T R - T G R T P Q Q V L D E A M W G V F Q E G W R Q - G
SEQ_325  Q S I R E - - - L N L - T N R T Y R N V L D A A C F A V F Q E G Y K D - G
SEQ_326  Q S I R E - - - L T R - T N R T P D D V M D A A V W A V L Q E G Y K D - G
SEQ_327  Q S I R E - - - L T L - T N R S M N D M L D A A A F A V F Q E G Y K G - G
SEQ_328  Q S I R E - - - L N L - T G R T Y E D V I S A A A W A V F Q E G Y T K - G
SEQ_329  Q S I R E - - - M T R - T G R T P Q E V L D D A T W G A F A A G W R G - A
SEQ_330  Q S P R E - - - L I K - T K R D F K D V L L K S A M G V L E T G Y T G - K
SEQ_331  Q S V R E - - - N Q R - L N R T P Q E V M T A A V W S L F A E N W R L - P
SEQ_332  Q S P R E - - - L A R - T G R D F R S V L L D A A W G V F A S G F A G - P
SEQ_333  Q S P R E - - - L I K - T N R D F K D V L L K V V L G V L E T G Y I G - H
SEQ_334  Q S I R E - - - L N F - T G R T F T D V R K D V L N A L V E E N Y V G - N
SEQ_335  K S Y R E - - - H T I - I G S R P E D V R R M A D R A V S S L G W E G - P
SEQ_336  S V E R A - - - L K K - I A G V P V E E - - - - P L S E E E V S W S I - G
```

FIG. 17 CONTINUED

```
AS MUT   ■□□□□□■□□□□□□□□□□□□□□□□□□□□□□□□□□
S/E MUT  □□□□□□□□■□□□□□□□■■■□■■■□□■■□■■■□■
L/C ONLY □□□□□□□□□□□□□□□□□■■□■□■□□■□□■■□□■
L/C MUT  □□■□□□□□□■□□□■□■□□□□□□□□□□□□□□□□□
RESNUM   4 4 4 4 5   5 5 5   5 5 5 5 5 6 6 6 6 6 6 6 6 6 6 7 7 7 7 7 7 7 7 7
         6 7 8 9 0   1 2 3   4 5 6 7 8 9 0 1 2 3 4 5 6 7 8 9 0 1 2 3 4 5 6 7 8

SEQ_337 Q S I R E - - - M T R - T G R T P Q Q V L D E A M W G V F Q E G W R Q - G
SEQ_338 Q S P R E - - - L I K - T K R D F K D V L L K S V I G V L E I G Y T D - S
SEQ_339 Q S P R E - - - L V K - T H R D F K D V F L K V I L G V L E A G Y A G - G
SEQ_340 Q S P R E - - - L E K - T H R D F K D A L L K V I L G V L E A G Y T G - E
SEQ_341 Q S P R E - - - L E K - T R R D F K D A L L K V I L G V L E A G Y T G - E
SEQ_342 Q S P R E - - - L I K - T N R D F K D V L L K V V L G V L E T G Y I G - H
SEQ_343 Q S P R E - - - L I K - T N R D F K D V L L K V V L G V L E T G Y I G - H
SEQ_344 Q S P R E - - - L I K - T N R D F K D V L L K V V L G V L E T G Y I G - H
SEQ_345 Q S P R E - - - L I K - T N R D F K D V L L K V V L G V L E T G Y I G - H
SEQ_346 Q S P R E - - - L V K - T N R D F K D V L L K V V L G V L E T G Y I G - H
SEQ_347 Q S I R E - - - L N F - T G R T F S D V R K D V L N A L I E E N Y V G - N
SEQ_348 Q S P R E - - - L V K - T N R D F K D V L L K V V L G V L E T G Y I G - H
SEQ_349 Q S I R E - - - L N F - T G R T F I D V R K D A L N A L V E E N Y V G - N
SEQ_350 K S Y R E - - - H T I - I G S R P E D V R R M A D K A V S A L E W E G - P
SEQ_351 - - - - - - - - - - - - - - - - - - - - - - - - - - - - - - - - - - - -
SEQ_352 Q S V R E - - - N E R - T G R T W R D V L D D A T W G V F Q E G Y S E - G
SEQ_353 Q S P R E - - - L M K - T H R S F K E A I L K A I L G V L E E G Y T G - K
SEQ_354 Q S V R E - - - M E R - T E S N W Q K V L D N A I W G C F E A G Y E G - K
SEQ_355 Q S V R E - - - L T L - T N R T Y S D V L D A A T W A V L Q E G Y E G - G
SEQ_356 Q S V R E - - - L N L - T G R T F K S V L D D V S W A V F Q E G Y Q A - G
SEQ_357 Q S V R E - - - L N L - T G R T F K S V L D D V S W A V F Q E G Y Q A - G
SEQ_358 Q S V K E - - - L K L - T G R S F K S V L D D V S W A V F Q E G Y Q N - G
SEQ_359 Q S I R E - - - L T L - L N R T M T D I L D A A A F A V F Q E G Y K D - G
SEQ_360 Q S P R E - - - L M K - T H R S F R E A I L K A I L G V L E E G Y T G - K
SEQ_361 Q S I R E - - - N A R - T G R T P Q E V M D D A M W G V F Q E G W R A - G
SEQ_362 Q S P R E - - - L M K - T H R S F K E A I L K A I L G V L E E G Y T G - K
SEQ_363 Q S P R E - - - L M K - T H R S F K E A I L K A I L G V L E E G Y T G - K
SEQ_364 Q S P R E - - - L E K - T H R D F R D V L L K A V L G V L E A G Y T G - E
SEQ_365 Q S P R E - - - L V K - T N R D F K D V L L K A I L G V L E A G Y A G - G
SEQ_366 Q S I R E - - - L T L - M H R T N T D V L L S A S W A V F E E G F T F - G
SEQ_367 Q S I R E - - - L N F - T G R T F T D V R K D V L N A L I E E N Y V G - N
SEQ_368 Q S I R E - - - L N F - T G R T F H D V K K D V E N A V I K E N Y E G - K
SEQ_369 Q S I R E - - - L N F - T G R T F T D V R K D V L N A L V E E N Y V G - N
SEQ_370 Q S I R E - - - L N F - T G R T F R D V R K D V L N A L V E E N Y V G - N
SEQ_371 K S N R E - - - H T T - I G S K P E D N R D A A Q K A I Q K A G W S K - P
SEQ_372 K S Y R E - - - H S I - I H T E P G Q V R K E A D W A V A A L G W Q D - P
SEQ_373 S S - E A - - - V K R - I S G G G T H R - - - - V L S E E E V R S A L - K
```

FIG. 17 CONTINUED

```
AS MUT   [grid pattern]
S/E MUT  [grid pattern]
L/C ONLY [grid pattern]
L/C MUT  [grid pattern]
RESNUM   79 80 81 82 83 84 85 86 87 88 89 90 91  92 93 94 95 96 97 98 99 100 101 102 103 104 105 106 107 108 109 110

SEQ_6    I I L G G D H L G P L P W - - - - - Q D E P S P T A M N K A K D L I R A F
SEQ_1    L I L G G D H L G P N R W - - - - - T K L S A S R A M D Y A R E Q I A A Y
SEQ_2    V I L G G D H L G P Y P W - - - - - R K E P A E T A I A Q A L E M V R A Y
SEQ_3    L I L G G D H L G P L I W - - - - - K N E S S N L A L A K A S E L I K E Y
SEQ_4    I I L G G D H L G P L P W - - - - - K N Q Q A K K A M E E A K E L V K Q F
SEQ_5    I I L G G D H L G P F V W - - - - - R D Q E P E I A M E Y A K Q M I K E Y
SEQ_7    L Y P C L D H G G P W L K D R H A Q E K L P L D Q A M H E V K L S L T A C
SEQ_8    V V L G L D H G G P W K K D L H A R N R L S F E E T F Q A V L R A I E A C
SEQ_9    W A L H A D H I G I K K - - - - - - - - G D R E D I E K T K E L V K A Q
SEQ_10   I I L G G D H L G P L P W - - - - - K N Q Q A K K A M E E A K E L V K Q F
SEQ_11   I I L G G D H L G P L T W - - - - - S K E T E K E A M A K S H E L V K E Y
SEQ_12   I I L G G D H L G P N P W - - - - - K G Q P S D Q A M R N A I E M I R E Y
SEQ_13   L F L G G D H L G P L T F - - - - - A G M D E A Q A M E N A E E L I R H Y
SEQ_14   I I L G G D H L G P L T W - - - - - T K L V Q E E A M E K A K V L I R D Y
SEQ_15   I L L G G D H L G P N P W - - - - - R D R P A D Q A L N Q A R I L V Q E Y
SEQ_16   L I L G G D H L G P N R W - - - - - Q N L P A Q Q A M A N A D D L I K S Y
SEQ_17   L L L G G D H L G P E P W - - - - - K N E N A D T A M D K A K Q L V I E F
SEQ_18   V I L G G D H L G P L P W - - - - - Q D E P S S S A M K K A K D L I R A F
SEQ_19   V V L G L D H G G P W K K D L H A R N R L S F A E T V Q A V L R A I E A C
SEQ_20   V V L G L D H G G P W K K D W H V R N R L P Y E A T L Q A V L R A I E A C
SEQ_21   Y Y V C R D H G G P W Q R D K E R N D H L P V E E A M A L G K K S Y L A D
SEQ_22   Y F L C R D H G G P W Q R D N E R N A H L P E N E A M E L G K K S Y L E D
SEQ_23   W S L H A D H I G I K K - - - - - - - - G T D E E I E S I K K L V K A Q
SEQ_321  F G A D A D H V K - - - - - - - - - - - - - - - - - - - - E I E D L E K A
SEQ_322  F G A D A D H V K - - - - - - - - - - - - - - - - - - - - K I E D L E S A
SEQ_323  F G A D A D H V K - - - - - - - - - - - - - - - - - - - - D I N D L M Q A
SEQ_324  Y G A D A D H L K - - - - - - - - - - - - - - - - - - - - T E E D A D R C
SEQ_325  F G A D G D H L K - - - - - - - - - - - - - - - - - - - - T E E D I Q S A
SEQ_326  F G S D A D H L K - - - - - - - - - - - - - - - - - - - - T F E D I D L M
SEQ_327  Y G A D G D H I K - - - - - - - - - - - - - - - - - - - - E E S D I Q Y A
SEQ_328  Y G A D G D H L K - - - - - - - - - - - - - - - - - - - - T A E E V K M S
SEQ_329  L G A D A D H Q K - - - - - - - - - - - - - - - - - - - - T V A D L E R C
SEQ_330  Y G A D A D H I K - - - - - - - - - - - - - - - - - - - - D E K Y L M E A
SEQ_331  W G A D A D H V K - - - - - - - - - - - - - - - - - - - - E P E H L A P Y
SEQ_332  F G A D A D H L Q - - - - - - - - - - - - - - - - - - - - D D E Q L R A A
SEQ_333  F G A D A D H I K - - - - - - - - - - - - - - - - - - - - D E Y Y L L E G
SEQ_334  S G F D G D H L K - - - - - - - - - - - - - - - - - - - - S D E E I Q Y A
SEQ_335  Y F V D A D H I T - - - - - - - - - - - - - - - - - - - - T K T V - D L F
SEQ_336  Y V E - - R - - - - - - - - - - - - - - - - - - - - - - - - - - E L R E A A
```

FIG. 17 CONTINUED

| RESNUM | 79 | 80 | 81 | 82 | 83 | 84 | 85 | 86 | 87 | 88 | 89 | 90 | 91 | 92 | 93 | 94 | 95 | 96 | 97 | 98 | 99 | 100 | 101 | 102 | 103 | 104 | 105 | 106 | 107 | 108 | 109 | 110 |
|---|---|---|---|---|---|---|---|---|---|---|---|---|---|---|---|---|---|---|---|---|---|---|---|---|---|---|---|---|---|---|---|---|
| SEQ_337 | Y | G | A | D | A | D | H | L | K | - | - | - | - | - | - | - | - | - | - | - | - | - | - | - | T | E | E | D | A | D | R | C |
| SEQ_338 | Y | G | A | D | A | D | H | I | K | - | - | - | - | - | - | - | - | - | - | - | - | - | - | - | D | E | K | Y | L | M | E | A |
| SEQ_339 | Y | G | A | D | A | D | H | I | K | - | - | - | - | - | - | - | - | - | - | - | - | - | - | - | D | E | K | Y | L | I | E | A |
| SEQ_340 | F | G | A | D | A | D | H | I | K | - | - | - | - | - | - | - | - | - | - | - | - | - | - | - | D | E | K | Y | L | L | R | A |
| SEQ_341 | F | G | A | D | A | D | H | I | K | - | - | - | - | - | - | - | - | - | - | - | - | - | - | - | D | E | K | Y | L | L | R | A |
| SEQ_342 | F | G | A | D | A | D | H | I | K | - | - | - | - | - | - | - | - | - | - | - | - | - | - | - | D | E | Y | Y | L | L | E | G |
| SEQ_343 | F | G | A | D | A | D | H | I | K | - | - | - | - | - | - | - | - | - | - | - | - | - | - | - | D | E | Y | Y | L | L | E | G |
| SEQ_344 | F | G | A | D | A | D | H | I | K | - | - | - | - | - | - | - | - | - | - | - | - | - | - | - | D | E | Y | Y | L | L | E | G |
| SEQ_345 | F | G | A | D | A | D | H | I | K | - | - | - | - | - | - | - | - | - | - | - | - | - | - | - | D | E | Y | N | L | L | E | G |
| SEQ_346 | Y | G | A | D | A | D | H | I | K | - | - | - | - | - | - | - | - | - | - | - | - | - | - | - | D | E | K | Y | L | L | E | G |
| SEQ_347 | S | G | F | D | G | D | H | L | K | - | - | - | - | - | - | - | - | - | - | - | - | - | - | - | S | D | E | E | I | Q | Y | A |
| SEQ_348 | Y | G | A | D | A | D | H | I | K | - | - | - | - | - | - | - | - | - | - | - | - | - | - | - | D | E | K | Y | L | L | E | G |
| SEQ_349 | S | G | F | D | G | D | H | L | K | - | - | - | - | - | - | - | - | - | - | - | - | - | - | - | S | D | E | E | I | Q | Y | A |
| SEQ_350 | Y | F | V | D | A | D | H | I | T | - | - | - | - | - | - | - | - | - | - | - | - | - | - | - | T | K | T | V | - | E | L | F |
| SEQ_351 | - | - | - | - | - | - | - | - | - | - | - | - | - | - | - | - | - | - | - | - | - | - | - | - | - | - | - | - | - | - | - | - |
| SEQ_352 | F | G | A | D | A | D | H | V | K | - | - | - | - | - | - | - | - | - | - | - | - | - | - | - | R | P | E | D | L | V | S | A |
| SEQ_353 | F | G | A | D | A | D | H | I | K | - | - | - | - | - | - | - | - | - | - | - | - | - | - | - | D | E | N | Y | L | M | E | A |
| SEQ_354 | F | G | A | D | A | D | H | V | K | - | - | - | - | - | - | - | - | - | - | - | - | - | - | - | D | L | K | N | L | K | E | A |
| SEQ_355 | F | G | A | D | G | D | H | L | K | - | - | - | - | - | - | - | - | - | - | - | - | - | - | - | T | A | E | E | I | K | G | A |
| SEQ_356 | F | A | A | D | A | D | H | L | K | - | - | - | - | - | - | - | - | - | - | - | - | - | - | - | E | K | P | D | I | K | E | A |
| SEQ_357 | F | A | A | D | A | D | H | L | K | - | - | - | - | - | - | - | - | - | - | - | - | - | - | - | E | K | P | D | I | K | E | A |
| SEQ_358 | F | G | A | D | A | D | R | L | K | - | - | - | - | - | - | - | - | - | - | - | - | - | - | - | E | K | P | E | I | K | E | A |
| SEQ_359 | Y | G | A | D | A | D | H | I | K | - | - | - | - | - | - | - | - | - | - | - | - | - | - | - | L | E | S | D | I | E | H | A |
| SEQ_360 | F | G | A | D | A | D | H | I | K | - | - | - | - | - | - | - | - | - | - | - | - | - | - | - | D | E | N | Y | L | M | E | A |
| SEQ_361 | F | G | A | D | A | D | H | L | K | - | - | - | - | - | - | - | - | - | - | - | - | - | - | - | T | L | A | D | V | D | I | C |
| SEQ_362 | F | G | A | D | A | D | H | I | K | - | - | - | - | - | - | - | - | - | - | - | - | - | - | - | D | E | N | Y | L | M | E | A |
| SEQ_363 | F | G | A | D | A | D | H | I | K | - | - | - | - | - | - | - | - | - | - | - | - | - | - | - | D | E | N | Y | L | M | E | A |
| SEQ_364 | F | G | A | D | A | D | H | I | K | - | - | - | - | - | - | - | - | - | - | - | - | - | - | - | D | E | R | Y | L | L | E | A |
| SEQ_365 | F | G | A | D | A | D | H | I | K | - | - | - | - | - | - | - | - | - | - | - | - | - | - | - | D | E | K | Y | L | M | E | A |
| SEQ_366 | W | G | A | D | G | D | H | V | K | - | - | - | - | - | - | - | - | - | - | - | - | - | - | - | T | E | Y | E | V | D | Y | A |
| SEQ_367 | S | G | F | D | G | D | H | L | K | - | - | - | - | - | - | - | - | - | - | - | - | - | - | - | S | D | E | E | I | Q | Y | A |
| SEQ_368 | S | G | F | D | G | D | H | L | K | - | - | - | - | - | - | - | - | - | - | - | - | - | - | - | T | D | E | E | I | K | M | A |
| SEQ_369 | S | G | F | D | G | D | H | L | K | - | - | - | - | - | - | - | - | - | - | - | - | - | - | - | S | D | E | E | I | Q | Y | A |
| SEQ_370 | S | G | F | D | G | D | H | L | K | - | - | - | - | - | - | - | - | - | - | - | - | - | - | - | S | D | E | E | I | Q | Y | A |
| SEQ_371 | W | Y | I | D | A | D | H | I | N | - | - | - | - | - | - | - | - | - | - | - | - | - | - | - | L | D | T | V | - | D | N | F |
| SEQ_372 | Y | H | V | D | A | D | H | I | S | - | - | - | - | - | - | - | - | - | - | - | - | - | - | - | M | K | T | V | - | D | L | F |
| SEQ_373 | Y | I | E | - | - | D | - | - | - | - | - | - | - | - | - | - | - | - | - | - | - | - | - | - | - | - | E | I | R | E | A | V |

FIG. 17 CONTINUED

```
AS MUT
S/E MUT
L/C ONLY
L/C MUT
RESNUM   111 112 113 114 115 116 117 118 119 120 121 122 123 124 125 126 127 128 129 130 131   132 133 134 135 136 137 138 139 140 141 142 143
SEQ_6     V   E   S   G   Y   K   K   I   H   I   D   C   S   M   P   L   S   D   D   P   K    -   -   -   -   V   L   P   Y   E   K   I   A   E   R   T   R
SEQ_1     V   K   A   G   F   S   K   I   H   L   D   A   T   M   P   L   Q   N   D   A   T    D   S   A   G   R   L   P   V   E   T   I   A   Q   R   T   A
SEQ_2     V   Q   A   G   Y   T   K   I   H   L   D   A   S   M   P   C   A   D   D   D   P    -   -   E   R   P   L   P   L   E   R   I   A   R   R   A   A
SEQ_3     V   L   A   G   Y   T   K   I   H   I   D   T   S   M   R   L   K   D   D   T    -   -   -   -   -   D   F   N   T   E   I   I   A   Q   R   S   A
SEQ_4     V   M   A   G   F   T   K   I   H   V   D   T   S   M   L   L   G   D   D   N   I    -   -   N   I   K   L   D   T   E   T   I   A   E   R   G   A
SEQ_5     I   K   A   G   F   T   K   I   H   I   D   T   S   M   P   L   K   G   E   N    -   -   -   -   -   S   I   D   D   E   I   I   A   K   R   T   A
SEQ_7     L   E   A   G   Y   A   L   L   H   I   D   P   T   V   D   R   T   L   P   P   G    -   -   -   E   A   P   L   V   P   I   V   V   E   R   T   V
SEQ_8     L   D   A   G   Y   G   L   L   H   L   D   P   T   V   D   L   E   L   S   P   G    -   -   -   T   P   V   P   I   P   R   I   V   E   R   S   V
SEQ_9     I   D   A   G   Y   T   S   F   A   I   D   A   S   H   L   F   N   F   Q   G   G    D   L   R   E   E   L   K   D   N   I   D   A   T   -   -   T
SEQ_10    V   M   A   G   F   T   K   I   H   V   D   T   S   M   F   L   G   D   D   N   I    -   -   N   I   K   L   D   T   E   T   I   A   E   R   G   A
SEQ_11    V   M   A   G   F   T   K   I   H   L   D   T   S   M   Y   L   A   D   D   D   R    -   -   S   K   K   L   A   T   E   V   I   A   R   R   G   A
SEQ_12    A   K   A   G   F   T   K   L   H   L   D   A   S   M   R   L   A   D   D   P   G    N   E   N   E   P   L   N   P   E   V   I   A   E   R   T   A
SEQ_13    V   G   A   G   F   T   K   I   H   I   D   T   S   M   K   V   A   S   D   D   P    -   -   N   T   R   L   S   D   E   T   I   A   K   R   G   A
SEQ_14    V   L   A   G   F   T   K   I   H   I   D   T   S   M   P   I   Y   D   D   L   E    -   -   K   G   V   F   G   D   D   L   I   A   E   R   A   A
SEQ_15    V   R   A   G   Y   G   K   I   H   L   D   A   S   M   A   C   G   G   D   P   A    -   -   D   A   P   L   D   K   A   V   A   A   E   R   A   A
SEQ_16    V   A   A   G   F   K   K   I   H   L   D   C   S   M   S   C   E   D   D   P   V    -   -   -   -   P   L   T   D   A   I   V   A   E   R   A   A
SEQ_17    V   K   N   G   F   N   K   I   H   L   D   C   S   M   P   L   K   G   D   S   D    -   -   -   -   F   -   S   T   T   L   V   A   D   R   E   A
SEQ_18    V   E   S   G   Y   K   K   I   H   L   D   C   S   M   S   L   S   D   D   P   V    -   -   -   -   V   L   S   P   E   K   I   A   E   R   E   R
SEQ_19    L   D   A   G   Y   G   L   L   H   L   D   P   T   V   D   L   E   L   P   P   G    -   -   -   T   P   V   P   I   P   R   I   V   E   R   T   V
SEQ_20    L   D   A   G   Y   G   L   L   H   L   D   P   T   V   D   L   E   L   P   P   G    -   -   -   T   P   V   P   I   P   R   I   V   E   R   T   V
SEQ_21    I   E   A   G   F   D   L   L   M   I   D   P   T   K   D   P   -   F   E   I   G    -   -   -   K   V   I   P   L   E   K   V   I   E   R   T   V
SEQ_22    L   I   N   G   F   D   L   L   H   I   D   P   T   K   D   P   -   Y   I   V   G    -   -   -   K   T   V   P   M   E   I   V   L   K   R   T   I
SEQ_23    I   D   A   G   Y   T   S   F   A   I   D   A   S   H   L   F   N   F   R   G   G    N   L   R   E   E   L   K   D   N   I   E   A   T   -   -   T
SEQ_321   S   N   E   G   F   T   M   Y   T   V   D   P   S   D   H   I   K   -   D   V   S    -   -   -   -   K   L   S   Q   K   E   F   Q   S   L   Y   Q
SEQ_322   A   R   A   G   Y   T   M   F   T   I   D   P   S   D   H   V   K   -   D   P   A    -   -   -   -   K   F   D   K   R   E   L   V   R   F   Y   E
SEQ_323   A   Y   E   G   Y   S   M   Y   T   V   D   P   S   D   H   V   K   -   N   I   D    -   -   -   -   K   I   N   Q   G   E   L   V   E   F   Y   K
SEQ_324   I   E   A   G   F   T   F   F   T   I   D   P   S   A   Y   V   D   N   E   V   D    -   -   -   -   T   A   D   A   A   T   L   E   A   K   V   A
SEQ_325   L   D   L   G   F   T   M   I   T   L   D   C   S   E   M   I   D   N   T   I   D    -   -   -   -   K   L   T   D   T   E   V   E   E   K   Y   Y
SEQ_326   L   N   A   G   F   T   M   F   T   F   D   P   S   E   H   V   D   N   E   A   D    -   -   -   -   N   Y   S   E   D   Q   L   K   Q   K   L   G
SEQ_327   L   S   L   G   A   S   M   I   T   L   D   C   S   D   H   I   D   N   T   I   E    -   -   -   -   K   A   S   P   E   V   L   D   E   K   F   N
SEQ_328   L   N   V   G   M   T   M   I   T   L   D   C   S   E   H   I   D   N   S   A   A    -   -   -   -   H   A   G   L   S   E   L   R   E   K   Y   S
SEQ_329   A   A   A   G   F   T   L   F   T   V   D   P   S   D   H   V   D   D   S   A   H    -   -   -   -   G   A   P   A   S   D   L   E   A   K   V   A
SEQ_330   I   D   A   G   Y   T   M   Y   T   L   D   I   S   D   F   I   E   -   K   I   K    -   -   -   -   D   L   S   E   K   A   L   K   E   K   -   -
SEQ_331   V   A   A   G   Y   T   F   Y   T   I   D   P   S   D   H   V   D   N   A   A   H    -   -   -   -   T   D   D   L   A   V   L   R   S   K   C   E
SEQ_332   A   E   A   G   Y   S   L   Y   T   F   D   L   R   R   A   L   A   -   R   G   P    -   -   -   -   -   -   -   -   -   -   -   -   R   P   -   -
SEQ_333   I   N   A   G   Y   T   M   Y   T   L   D   L   S   E   Q   L   I   -   D   I   S    -   -   -   -   S   L   N   P   S   E   M   R   N   K   -   -
SEQ_334   L   D   S   G   I   T   M   L   T   L   D   C   S   E   H   M   N   -   K   D   S    -   -   -   -   S   I   -   -   -   -   -   -   -   -   -   -
SEQ_335   L   -   D   S   A   D   F   F   T   I   D   V   A   E   A   I   G   K   G   E   V    -   -   -   -   S   P   Q   E   E   E   -   -   D   L   -   -
SEQ_336   E   A   G   G   V   D   F   V   T   I   D   T   C   E   L   I   D   Y   S   Y   D    -   -   -   -   K   V   G   A   E   E   V   A   A   A   Y   E
```

FIG. 17 CONTINUED

```
RESNUM: 111 112 113 114 115 116 117 118 119 120 121 122 123 124 125 126 127 128 129 130 131   132 133 134 135 136 137 138 139 140 141 142 143

SEQ_337  I E A G F T F F T I D P S A Y V D N E V D - - - - T A D A A T L E A K V A
SEQ_338  I D A G Y T M Y T L D I S D F I E - R I E - - - - N L T S K E I R E K - -
SEQ_339  I D A G Y T M Y T L D L S D L L V - K I S - - - - D M P K S Q L K E K - -
SEQ_340  I E A G Y T M Y T L D V S E L L T - K I L - - - - D I S S N Q V M - - - -
SEQ_341  I E A G Y T M Y T L D V S E L L T - K I S - - - - D I S S N Q V M - - - -
SEQ_342  I N A G Y T M Y T L D L S E Q L I - D I S - - - - S L N P S E M R N K - -
SEQ_343  I N A G Y T M Y T L D L S E Q L I - D I S - - - - S L N A S E M R N K - -
SEQ_344  I N A G Y T M Y T L D L S E Q L I - D I S - - - - S L N P S E M R N K - -
SEQ_345  I N A G Y T M Y T L D L S E Q L I - D I S - - - - S L N A S E M R N K - -
SEQ_346  I D A G Y T M Y T L D L S E Q L F - D V S - - - - G A T S L E I K E K - -
SEQ_347  L D S G I T M L T L D C S E H M N N K D S - - - - S I - - - - - - - - - -
SEQ_348  I D A G Y T M Y T L D L S E Q L F - D I S - - - - G A T P S A I K E K - -
SEQ_349  L D S G I T M L T L D C S E H M N - K D S - - - - S I - - - - - - - - - -
SEQ_350  L - D S S D F F T I D V A E A I G Q E E I - - - - S P Q E E E - - D L - -
SEQ_351  - - - - - - - - - - - - - - - - - - - - - - - - - - - - - - - - - - - -
SEQ_352  A R E G F T M F T I D P S D H V R - N L S - - - - K L T E K E R N E K F E
SEQ_353  I D A G Y T M Y T L D L S D M L V - K L S - - - - D Y T E S Q L K E K - -
SEQ_354  I D C G F T F Y T I D P S D H I D A N I L - - - - K L D K D E L R N K Y Q
SEQ_355  L D L G F T M I T L D A S A H I D N T V G - - - - Q K A A K Q V A E L Y H
SEQ_356  L D L G Y T M L T L D C T D Y I N D D L D - - - - Q M S E S E I E N A Y A
SEQ_357  L D L G Y T M L T L D C T D Y I N D D L D - - - - Q M S E S E V E N A Y A
SEQ_358  L D L G Y T M L T L D C T D Y I N D N F D - - - - Q T A E S D I E S A Y A
SEQ_359  L Q L G F S F L T L D C S E Q I R N D V E - - - - S Q T S D E I Q N E F A
SEQ_360  I D A G Y T M Y T L D L S D M L V - K L S - - - - D Y T E S Q L K E K - -
SEQ_361  A A A G Y T F Y T V D P G D H V D D E A N - - - - T A A F P A L E A R V D
SEQ_362  I D A G Y T M Y T L D L S D M L V - K L S - - - - D Y T E S Q L K E K - -
SEQ_363  I D A G Y T M Y T L D L S D M L V - K L S - - - - D Y T E S Q L K E K - -
SEQ_364  A D A G Y T M Y T L D V S E M L V - K G D - - - - V S - - - - - P D K - -
SEQ_365  I D A G Y T M Y T L D L S D L L V - K I S - - - - D M P E S Q L K E K - -
SEQ_366  V K V G C S M I T L D C T D V I N N D A V - - - - T M S D E E L D K T F N
SEQ_367  L D S G I T M L T L D C S E H M N - K D S - - - - S I - - - - - - - - - -
SEQ_368  I D S G I T M L T L D C S E Y M G - V V S - - - - K I - - - - - - - - - -
SEQ_369  L D S G I T M L T L D C S E H M N - K D S - - - - S I - - - - - - - - - -
SEQ_370  L D S G I T M L T L D C S E H M N - K D S - - - - S V - - - - - - - - - -
SEQ_371  L - E S S D F F T I D V A S Y I G K K G D - - - - S K E E E - - - - T - -
SEQ_372  L - D S S D F F T L D V A D Y T G K A A D - - - - E A S I A - - - - R - -
SEQ_373  S T R N I Y F Y T I D T C D L I D Y S S E - - - - K I A V D E L R T V F K
```

Tracks above alignment: AS MUT, S/E MUT, L/C ONLY, L/C MUT

FIG. 17 CONTINUED

```
AS MUT    [■ at 166-168 region]
S/E MUT   [■ at various]
L/C ONLY  [■ at various]
L/C MUT   [■ at various]
RESNUM    144 145 146 147 148  149 150 151 152 153 154 155 156       157  158 159 160 161 162 163 164 165 166 167 168 169

SEQ_6   E L F E I - A E E T A R K Y - - - - - N - F Q P V Y V V G T D V P - - - -
SEQ_1   E L C A V - A E Q T Y R Q S D - - - Q L F P P P V Y I V G S D V P - - - -
SEQ_2   Q L C A A - A E A A - - - - - - - - - A G A V Q P V Y V I G S E V P - - - -
SEQ_3   V L L K A - A E N A Y M E L N K N N K N V L H P V Y V I G S E V P - - - -
SEQ_4   I L V S V - A E R A F E E L K K F N P Y A L H P V Y V I G S E V P - - - -
SEQ_5   V L C R I - A E E C F E K I S I N N P Y I T R P V Y V I G A D V P - - - -
SEQ_7   E L I E H - A E Q E R Q R L - - - - - N L P A V A Y E V G T E E - - - - -
SEQ_8   A L L R H - A E T Y R L R R - - - - - N L P P V A Y E V G T E E - - - - -
SEQ_9   E I A K F - I E E Q - - - M - - - - - - - D D R E Y G L E V E V G - - - -
SEQ_10  I L V S V - A E R A F E E L K K S N P Y A L H P V Y V I G S E V P - - - -
SEQ_11  E L C K T - A E E S F K A L K E R N S M A V A P V Y I V G S E V P - - - -
SEQ_12  L L C L E - A E R A F K E S - - - A G S L R P V Y V I G T D V P - - - -
SEQ_13  R L A R V - A Q D T Y H K L L E S D P D A I A P V Y I V G S E V P - - - -
SEQ_14  I L C N V - A E I A Y R E L L K T N E D A I H P I Y V V G S E V P - - - -
SEQ_15  A L A E A - A E A A F Q R M - - - - G S G T P P C Y V I G T E V P - - - -
SEQ_16  R L A K I - A E A T C R E Q - - - - F G V T D L V Y V I G T E V P - - - -
SEQ_17  E L C A V - A E E T Y E K Y - - - - - G G N R P V Y V V G T E V P - - - -
SEQ_18  E L L E V - A E E T A R K Y - - - - - N - F Q P V Y V V G T D V P - - - -
SEQ_19  A L L R H - A E T Y R L R R - - - - - N L P P V A Y E V G T E E - - - - -
SEQ_20  A L L Q H - A E T Y R Q Q R - - - - - R L P P V A Y E V G T E E - - - - -
SEQ_21  E L I E F - C E K E R Q A R - - - - - D L P E I G Y E V G T E E - - - - -
SEQ_22  E L I E Y - V E R E R K E R - - - - - N L P P I S Y E V G T E E - - - - -
SEQ_23  K V A R F - I D E Q - - - M - - - - - - - E D R D Y G L E V E V G - - - -
SEQ_321 D N K I R - - - - - - R E L - - - E M R Y V G K L Y K F K - D F E - - - F
SEQ_322 E H P M R - - - - - - R T L - - - E M K Y I G K S F T V L - G E K - - - L
SEQ_323 S H P L R - - - - - - K E I - - - E M I Y S G K V F S F E - K S K - - - F
SEQ_324 A L P W E A L E T T L A D L - - - R R A Y L G Q H F Q V G - P Y E - - - L
SEQ_325 Q L P Q S - - - - V R E R Y - - - E T R Y L D K C F E L R - N S K - - - I
SEQ_326 E I D W S G L Q D T S A D A - - - A K R Y V D M T F N I S E R L S - - - L
SEQ_327 A L S E V - - - - V K Q R Y - - - M E Q Y L G K T F E V N - G L T - - - L
SEQ_328 R F T E E - - - - E R E R W - - - E R K Y L N R D V K I G - N Y S - - - F
SEQ_329 A L P W R E L E T T R A D F - - - E - R Y A G R R L E L G - D R E - - - L
SEQ_330 - - - Y E K V S S F S K K I - - - I D K Y A G K R V K I S D E E Y - - - F
SEQ_331 A L P W D I L E T T Y L S L - - - C E N Y C G R T I V A E - K T T - - - L
SEQ_332 - - - W E A L S P L A R S V - - - V A E L A D R R V E A P - Q G P - - - R
SEQ_333 - - - A Q E L S Q V S K D I - - - I K D F S G K K L D I I S D S G - - - Y
SEQ_334 - - - - - - - - - - K D Q I - - - F E Q F Y N K S F F V N - D M P - - - I
SEQ_335 - - - - - - - - - - L A S L - - - G D L L N R E L A I P G L S S P - - - L
SEQ_336 E V F D G - - - D E R R A L - - - E E R Y E G V H Y F L G - G D R V V A V
```

FIG. 17 CONTINUED

```
AS MUT
S/E MUT
L/C ONLY
L/C MUT
RESNUM  144 145 146 147 148  149 150 151 152 153 154 155 156       157 158 159 160 161 162 163 164 165 166 167 168 169
SEQ_337 A L P W D A L E T T L A D L - - - R R A Y L G Q H F Q V G - P Y E - - - L
SEQ_338 - - - Y E K I S S F S K K I - - - I E K Y A G K K I K I S N E E Y - - - F
SEQ_339 - - - A Q S L S S Q S R E I - - - I D R F K G K K F S I S T D E D - - - F
SEQ_340 - - - - - Q I S P Q S K E I - - - I E A F K G K K I S I S - E E E - - - Y
SEQ_341 - - - - - Q I S P Q S K E I - - - I E A F K G K K I S I S - E E E - - - Y
SEQ_342 - - - A Q E L S Q V S K D I - - - I K D F S G K K L D I I S D S G - - - Y
SEQ_343 - - - A Q E L S Q V S K D I - - - I K D F S G K K L D I I S D S G - - - Y
SEQ_344 - - - A Q E L S Q V S K D I - - - I K D F S G K K L D I I S D S G - - - Y
SEQ_345 - - - A Q E L S Q V S K D I - - - I K D F S G K K L D I I S D S G - - - Y
SEQ_346 - - - A K T L S D V S R K I - - - V E D F S G K S L N V G - F G G - - - H
SEQ_347 - - - - - - - - - - K E R I - - - F D Q F Y N K S F F V N - D M P - - - I
SEQ_348 - - - A E A L S D V S K K I - - - V E D F S G Q S L N V G - L E G - - - H
SEQ_349 - - - - - - - - - - K D Q I - - - F E Q F Y N K S F F V N - D M P - - - I
SEQ_350 - - - - - - - - - - L S S L - - - D D L L N R E L A I P G L S N P - - - L
SEQ_351 - - - - - - - - - - - - - - - - - - - - - - - - - - - - - - - - - - - - -
SEQ_352 E I L R K - - - - - - E R I - - - D R I Y L G K K Y S V L - G E K - - - I
SEQ_353 - - - A E K L N I T S K R I - - - I E R F K G K K F V M P T K E A - - - F
SEQ_354 Q L P E K - - - - - - D A L - - - E N S Y L N K E Y Q I G - S Q K - - - L
SEQ_355 T L P A D - - - - Y T A D M - - - E E H Y L G K A F I V G - G M A - - - I
SEQ_356 E V P D Y - - - - L R E G L - - - E N Q Y L N K T F V L N S G Y Q - - - L
SEQ_357 E V P D Y - - - - L R E G L - - - E N Q Y L N K T F V L N S G Y Q - - - L
SEQ_358 E V P D Y - - - - L R D G L - - - E S K Y L N K T F V L N S G Y Q - - - L
SEQ_359 S L S D E - - - - K R A Y F - - - S N Y Y L D Q T F N V H - E R Q - - - I
SEQ_360 - - - A E K L N I T S K R I - - - I E K F K G K K F V M P T E E A - - - F
SEQ_361 A L P W D V L D S S P A D L - - - A A R L A D R P I D L G - T L K - - - V
SEQ_362 - - - A E K L N I T S K R I - - - I E R F K G K K F V M P T K E A - - - F
SEQ_363 - - - A E K L N I T S K R I - - - I E K F K G K K F V M P T E E A - - - F
SEQ_364 - - - A D H L S Q H S R D I - - - I K D F S G K R I S F E - G G E - - - Y
SEQ_365 - - - A Q S L S S Q S R E I - - - I D R Y K G K K F S I S T D E D - - - F
SEQ_366 A L D D D - - - - Q K K Y F - - - N D T Y L D K T F D L G N G N S - - - V
SEQ_367 - - - - - - - - - - K D Q I - - - F E Q F Y N K S F F V N - D M P - - - I
SEQ_368 - - - - - - - - - - K E K I - - - Y K G F Y G K T F K V K - D L D - - - L
SEQ_369 - - - - - - - - - - K D Q I - - - F E Q F Y N K S F F V N - D M P - - - I
SEQ_370 - - - - - - - - - - K E S I - - - F D Q F Y N K S F F V N - D M P - - - I
SEQ_371 - - - - - - - - - - F I S K - - - M K P L I G N L N I P G V N S P - - - F
SEQ_372 - - - - - - - - - - F V A K - - - H Q H C I G K L Q I P G I E Q P - - - I
SEQ_373 D L Y P A - - - - - - - S L - - - I E R Y K D I N V V V N - G T R - - - I
```

FIG. 17 CONTINUED

```
AS MUT
S/E MUT
L/C ONLY
L/C MUT
RESNUM                                                              170 171 172   173 174 175 176

SEQ_6    - - - - - - - - - - - - - - - - - - - - - - - - - - - I A G - - G G E E
SEQ_1    - - - - - - - - - - - - - - - - - - - - - - - - - - - I P G - - G A Q E
SEQ_2    - - - - - - - - - - - - - - - - - - - - - - - - - - - P P G - - G A Q G
SEQ_3    - - - - - - - - - - - - - - - - - - - - - - - - - - - I P G - - G S Q G
SEQ_4    - - - - - - - - - - - - - - - - - - - - - - - - - - - V P G - - G S Q K
SEQ_5    - - - - - - - - - - - - - - - - - - - - - - - - - - - P P G - - G E S S
SEQ_7    - - - - - - - - - - - - - - - - - - - - - - - - - - - - - - - - - - - -
SEQ_8    - - - - - - - - - - - - - - - - - - - - - - - - - - - - - - - - - - - -
SEQ_9    - - - - - - - - - - - - - - - - - - - - - - - - - - - E I G - - R E - -
SEQ_10   - - - - - - - - - - - - - - - - - - - - - - - - - - - V P G - - G S Q K
SEQ_11   - - - - - - - - - - - - - - - - - - - - - - - - - - - I P G - - G I Q D
SEQ_12   - - - - - - - - - - - - - - - - - - - - - - - - - - - P P G - - G A Q N
SEQ_13   - - - - - - - - - - - - - - - - - - - - - - - - - - - I P G - - G A V G
SEQ_14   - - - - - - - - - - - - - - - - - - - - - - - - - - - V P G - - G V Q A
SEQ_15   - - - - - - - - - - - - - - - - - - - - - - - - - - - P P G - - G A Q G
SEQ_16   - - - - - - - - - - - - - - - - - - - - - - - - - - - V P G - - G A H E
SEQ_17   - - - - - - - - - - - - - - - - - - - - - - - - - - - A P G - - G S T N
SEQ_18   - - - - - - - - - - - - - - - - - - - - - - - - - - - V A G - - G G E E
SEQ_19   - - - - - - - - - - - - - - - - - - - - - - - - - - - - - - - - - - - -
SEQ_20   - - - - - - - - - - - - - - - - - - - - - - - - - - - - - - - - - - - -
SEQ_21   - - - - - - - - - - - - - - - - - - - - - - - - - - - - - - - - - - - -
SEQ_22   - - - - - - - - - - - - - - - - - - - - - - - - - - - - - - - - - - - -
SEQ_23   - - - - - - - - - - - - - - - - - - - - - - - - - - - E I G - - R E - -
SEQ_321  R M T D - E E F A E I F V T Y I D A I E H V C K C Y D V L K A K - G - K P
SEQ_322  T F D E - E N F A E V F V T Y I D A I E H V E K C Y R A L R A V - C K T S
SEQ_323  T M E D - K E L F R I F V T Y V D A I E H V V K C Y E A I K N T - K - K N
SEQ_324  S F E E - R T L M Q A L A K Y G G A I A H T A R M Y R H I A G R M G N R P
SEQ_325  C F S K - E N L M K N V L I Y G A A A D F I V A I Y E K Q I K H - R D Q K
SEQ_326  T I Q E - S D F L R A Y A K Y G N A I A H I K K M Y D Y L A S K A D K D T
SEQ_327  T L D E - T E L K K N V L L Y D K A I D Y T T H V Y N E Y I S K - E N R A
SEQ_328  H I S E - E D L I R M A C V Y G G A I R H T L D I Y H N I I A K - C G R P
SEQ_329  V L A R - E A V L R A G A K Y A R A V L H V A T L Y R H L E G K - - G A P
SEQ_330  E L S Y - N E L C K S A I V Y E K A L S F V E M V Y E I L K S K - - L S E
SEQ_331  H F D K - E T L L R A L A K Y G R A L A H T V R I A A A L R T A L G G T S
SEQ_332  T L E E - S A L R A A A C R Y E P A L E E V V R G A E I L R D Q - - G I D
SEQ_333  V V S E - E E L Y K S A V A Y E N A M K F V D K V N N I L K E K - - L S D
SEQ_334  E Y S D K N E L N K I V S I Y A S V I E R V I D V W N K F P K V - N K K E
SEQ_335  A I S E - E T A R G T I R A Y W P A V R E A A R I Y R R I E Q G - A S R P
SEQ_336  R L S R - E D V A R L A V K Y R R S L D Y A E R I Y R A A R E A - M G V E
```

FIG. 17 CONTINUED

```
RESNUM                                                         170 171 172   173 174 175 176
SEQ_337 S F E E - R T L L Q A L A K Y G G A I A H T A R V Y R H I A G R M G N R P
SEQ_338 E L S Y - D E L C K S A I V Y E K A L S F V E M V Y E I L R S K - - L L E
SEQ_339 A V S E - D E L Y K S A L T Y E K A M K F V E K V Y G I L K D R - - L Q H
SEQ_340 T I R E - D E L Y K S A L I Y E K A M N F V E K V Y S I L K E K - - V K D
SEQ_341 T I R E - D E L Y K S A L I Y E K A M N F V E K V Y S I L K E K - - V K D
SEQ_342 V V S E - E E L Y K S A V A Y E N S M K F V D K V N N I L K E K - - L S D
SEQ_343 V V S E - E E L Y K S A V A Y E N A M K F V D K V N N I L K E K - - L S D
SEQ_344 V V S E - E E L Y K S A V A Y E N A M K F V D K V N N I L K E K - - L S D
SEQ_345 V V S E - E E L Y K S A V A Y E N A M K F V D K V N N I L K E K - - L S D
SEQ_346 L V S E - D E L L K S A V A Y E A A M K F V E K V N D I L K E K - - L N D
SEQ_347 E Y S N K N E L N K I V S I Y A G V I E R V I D V W N K F P K V - N K K E
SEQ_348 L V S E - D E L L K S A I A Y E G A M K F V E K V N D I L K E K - - L N D
SEQ_349 E Y S D K N E L N K I V S I Y A S V I E R V I D V W N K F P K V - N K K E
SEQ_350 T I S E - E T A R E T I R A Y W P A V R E A A R I H Q R I E K G - T S R P
SEQ_351 - - - - - - - - - - - - - - - - - - - - - - - - - - - - M R A K E L - F G E D
SEQ_352 E F D E - K N L R D A A L V Y Y D A I A H V D M M Y Q I L K D E - T - P D
SEQ_353 T V S E - E E L Y K S A L T Y E K A M D F V E K V Y G I L K D K - - V K N
SEQ_354 T F T Q - D I L I E I V L T Y L E A I K H V E K C Y K F L K D S - H K G D
SEQ_355 T F D T - E T L Q R L V L T Y G K A L A F M G Y I Y H T L I V N - A G R E
SEQ_356 E Y N Q - D N F K E I V L I Y Y K M L D F A K E I Q H - L I K T - S A R N
SEQ_357 E Y N Q - D N F K E I V L I Y Y K M L D F A K E I Q H - L I K T - S A R N
SEQ_358 E Y N K - V N F K K I V L S Y Y Q I L D F V K E I Q H - L I K R - S A R D
SEQ_359 S F D Q - A N L A K N V L V Y G E A I D F M E H V Y H T Y L Q S - L D R D
SEQ_360 T V S E - E E L Y K S A L T Y E K A M D F V E K V Y G I L K D K - - V K N
SEQ_361 T L D R - E T L W R A A A K Y G R A V A H T V T M Y R H L A G A M G E R P
SEQ_362 T V S E - E E L Y K S A L T Y E K A M D F V E K V Y G I L K D K - - V K N
SEQ_363 T V S E - E E L Y K S A L T Y E K A M D F V E K V Y G I L K D K - - V K N
SEQ_364 T V K E - E E L Y R S A V I Y E K A M N F V E R V H G L L K E R - - L K D
SEQ_365 V V S E - D E L Y K S A L T Y E K A M K F V E K V Y G I L K D R - - L Q H
SEQ_366 H F T K - H D V E E S V L T F Y G A I L F A A D I Y K K F V V P - - - Y N
SEQ_367 E Y S D K N E L N E I V S I Y A S V I E R V I D V W N K F P K V - N K K E
SEQ_368 E Y S Q - E E L E K I L S I Y S G V I E R I I Y I W N N F P K V - K N K D
SEQ_369 E Y S D K N E L N K I V S I Y A S V I E R V I D V W N K F P K V - N K K E
SEQ_370 E Y S D K N E L N K I V S I Y G G V I E R V I D V W N K F P K V - N K K E
SEQ_371 K I T E - Q Q L R N I A G Q Y L H A A F M A G E T Y K Y I E S V K G K G N
SEQ_372 T I T E - T T L T S V A R K Y L L A I Q E A G K L Y R H I A N K K G P E N
SEQ_373 R F D E - E K V M R L S L K L M R S I D V S E R I Y R I I K E M - T P W P
```

FIG. 17 CONTINUED

```
AS MUT   ■                  ■
S/E MUT           ■   ■ ■   ■ ■■■■ ■■■  ■■■■
L/C ONLY                          ■■
L/C MUT              ■        ■  ■ ■ ■   ■      ■
RESNUM   177         178 179 180 181 182 183 184 185 186 187 188 189 190 191 192 193 194 195 196 197   198 199 200 201

SEQ_6    E - - - - - - - - - G V T S V E D F R S A I S S L K K Y F N - - D V P N
SEQ_1    A L - - - - - - - N Q I H I T E V K E V Q Q T I D H V R R A F E K N G L E A
SEQ_2    Q E - - - - - - - A R L H V T T P Q E A Q A A L D A F R E A F L Q A G L T P
SEQ_3    S D - - - - - - - E S L Q I T D A K D F E N T V E I F K D V F S K Y G L I N
SEQ_4    E N N - - - - - - N E I Q V T K P T D F E E T V E V Y K S T F Y K Y G L G N
SEQ_5    I C - - - - - - - - Q T I T T K D E L E R S L E Y F K E A F K K E G I E H
SEQ_7    - - - - - - - - - V H G G L V N F D N F V A F L D L L K A R L E Q R A L M H
SEQ_8    - - - - - - - - - V G G G L Q A E A R M A E F L D R L W T A L D R E G L P -
SEQ_9    D E - - - - - - - H G R V L T N P E E A V T - - - - F I K A L N E N G V - -
SEQ_10   E N N - - - - - - N E I Q V T K P A D F E E T V E V Y K S T F Y K Y G L G N
SEQ_11   E E - - - - - - - E G I Q V T K P E D F L E T V K V Y K A E F K D K G I D E
SEQ_12   E G - - - - - - - K S I H V T S V Q D F E R T V E L T K K A F F D H G L Y E
SEQ_13   A V - - - - - - - D Q G V Q V T K V E D F K N T V A T F E K A F R E Q G L D E
SEQ_14   E E A E E E I E N G I K V T R V E D F K N T V E V F K K K F K E H G V E E
SEQ_15   D D - - - - - - - M P L A I T A P R E V A E T I E L T Q A A F R R G L E A
SEQ_16   T L - - - - - - - T E L E V T T P D A A R A T L E A H R H A L E K E G L N D
SEQ_17   E V - - - - - - - - P E V T S I E E L D E M I E E L Q N A F L R L G L K N
SEQ_18   E - - - - - - - - - G I T S V E D F R V A I S S L K K Y F E - - D V P R
SEQ_19   - - - - - - - - - V G G G L Q A E A R M A E F L D R L W T A L D R E G L P -
SEQ_20   - - - - - - - - - V G G G L Q A E A R M A E F L D R L W T V L D R E G L P -
SEQ_21   - - - - - - - - - T N G G L T S T E T Y E T F I L R L Q E E L G R R D L P -
SEQ_22   - - - - - - - - - T N G G L T S E E A Y E T F I K T L I E E L D K R N L P -
SEQ_23   D E - - - - - - - Y G R V L T Q P E E A V T - - - - F I K A L N E N G V - -
SEQ_321  F D F E V S I D E T A V P T T P L A H I F - - - - I V K E L R R G I D F
SEQ_322  F D L E V S I D E T S V P T T S L A H I F - - - - F V Q E L V R R G V E F
SEQ_323  F D F E V S I D E T S I P T S P L A H I F - - - - I V H E L R R G V D F
SEQ_324  F E L E M S V D E T E V P T S P A E H F F - - - - V A R E L Q R L G V R W
SEQ_325  I D F E V S I D E T V T P T T P E A H Y F - - - - V A R E I Y D R Q V D I
SEQ_326  F E I E V S V D E T E S V T S P F E H F F - - - - F A N E L N R L G V K Y
SEQ_327  I D F E I S I D E T E T V T S P I S H F F - - - - V A N E L I N R G V K V
SEQ_328  I D F E M S I D E T L T P T S P A S H Y F - - - - V A Q E L I D G G V E I
SEQ_329  F E L E V S V D E T A T P T S H A E H A V - - - - V A L E L R R L G V R W
SEQ_330  F D I E V S I D E G E R D T T P E D H F F - - - - V A Q F L H D K G I D F
SEQ_331  F D L E M S V D E T D T P T S A H E H F F - - - - I A N E L L R R N I P L
SEQ_332  A D L E V S V D E T E E E T T P E A H A F - - - - I A V Y L Q R R G V A L
SEQ_333  F D M E I S I D E G G K V T T L E D H L Y - - - - V A E Y L H R N G I D F
SEQ_334  V T F E V S V D E T D V P T D E K T H F L - - - - I S K Y I Y D E G V K I
SEQ_335  F V V E V S M D E T D E P Q R P P E L L L - - - - I L A M I R K A G I P A
SEQ_336  L G F E V A F D E T P G V S E A R E V F F - - - - Y L S E L L R R G L R V
```

FIG. 17 CONTINUED

```
AS MUT  ■
S/E MUT
L/C ONLY
L/C MUT
RESNUM  177 178 179 180 181 182 183 184 185 186 187 188 189 190 191 192 193 194 195 196 197 198 199 200 201

SEQ_337  F E L E M S V D E T E V P T S P A E H F F - - - - V A R E L Q R L G V R W
SEQ_338  F D I E V S I D E G E R D T T P E D H F F - - - - V V Q F L H E K G I D F
SEQ_339  F D L E I S I D E G E K D T T V E D H I F - - - - V A E Y L H R K G I D F
SEQ_340  F D L E I S I D E G E K D T T V E D H I F - - - - V A E Y L H K K G I D F
SEQ_341  F D L E I S I D E G E K D T T V E D H I F - - - - V A E Y L H K K G I D F
SEQ_342  F D M E I S I D E G G K V T T L E D H L Y - - - - V A E Y L H R S G I D F
SEQ_343  F D M E I S I D E G G K V T T L E D H L Y - - - - V A E Y L H R N G I D F
SEQ_344  F D M E I S I D E G G K V T T L E D H L Y - - - - V A E Y L H R N G I D F
SEQ_345  F D M E I S I D E G G K V T T L E D H L Y - - - - V A E Y L H R N G I D F
SEQ_346  F D L E I S I D E G G K V T T L E D H L F - - - - V A E Y L H R N G I D F
SEQ_347  V T F E V S V D E T D V P T D E K T H F L - - - - I S K Y I Y D E G V K I
SEQ_348  F D L E I S I D E G G K V T T L E D H L F - - - - V A E Y L H R N G I D F
SEQ_349  V T F E V S V D E T D V P T D E K T H F L - - - - I S K Y I Y D E G V K I
SEQ_350  F V V E V S M D E T A D P Q R P P E L L L - - - - I L A M I R K A G I P A
SEQ_351  V S I E I A L D E S P S E T Q L K E L F F - - - - Y I N E L L Y K G L R F
SEQ_352  F D F E V S V D E T E T P T S P L F H I F - - - - V V E E L R R R G V E F
SEQ_353  F D L E I S I D E G D K D T T V E D H I F - - - - V A E Y L H E K G I D F
SEQ_354  F E L E V S V D E T P T P T S P L A H L W - - - - I A S E L Q R R G V D F
SEQ_355  V D F E I S I D E T A T P T T P A A H Y F - - - - V A S E L G R M G V K F
SEQ_356  V D F E I S I D E T S T P T T P E A H F F - - - - V A N E L K R N N I E V
SEQ_357  V D F E I S I D E T S T P T T P E A H F F - - - - V A N E L K R N N I E V
SEQ_358  V D L E I S I A D S L N S T S P E A H F F - - - - V A N E F K R N N I E V
SEQ_359  V D F E I S I D E T E T V T S P E A H F F - - - - V A E E L R R R G V K V
SEQ_360  F D L E I S I D E G D K D T T V E D H I F - - - - V A E Y L H E K G I D F
SEQ_361  F E L E M S V D E T A T V T S L A E H V Y - - - - I A A E L Q R L G V R C
SEQ_362  F D L E I S I D E G D K D T T V E D H I F - - - - V A E Y L H E K G I D F
SEQ_363  F D L E I S I D E G D K D T T V E D H I F - - - - V A E Y L H E K G I D F
SEQ_364  F D L E V S I D E G D R D T T V E D H I F - - - - V A E Y L H R R G I D F
SEQ_365  F D L E I S I D E G E K D T T V E D H I F - - - - V V E Y L H R K G I D F
SEQ_366  L D F E I S M D E T P Y Q T T N P N H F F - - - - F G N E L H K R G I V P
SEQ_367  V S F E V S V D E T D V P T D E K T H F L - - - - I S K Y I N D E G V K I
SEQ_368  V S F E V S I D E T N I P T D E K T H F L - - - - L S K Y L Y D E G I T I
SEQ_369  V T F E V S V D E T D V P T D E K T H F L - - - - I S K Y I Y D E G V K I
SEQ_370  V S F E V S V D E T D V P T D E K T H F L - - - - I S K Y I Y D E G V K I
SEQ_371  F I T E V S M D E V P E P Q T P V E L F F - - - - I L A M L A H Y G V P A
SEQ_372  F I T E V S I D E T D Q P Q G P E D L L F - - - - I L A M I A D E G I P A
SEQ_373  F G I E I A F D E T P V T S D P H E L F F - - - - V L N E L R T R G I P V
```

FIG. 17 CONTINUED

```
AS MUT
S/E MUT
L/C ONLY
L/C MUT
RESNUM    202 203 204 205 206 207 208 209 210 211 212 213 214 215 216 217 218  219 220 221 222 223 224 225 226 227 228
SEQ_6   - - I W D R V V G F V I M L G I G F S - Y D K V F E Y D R D - - - - - - -
SEQ_1   - - A Y E R V C A V V V Q P G V E F A - D Q I V F E Y A P D - - - - - - -
SEQ_2   - - V W E R V I A L V V Q P G V E F G - V D S I H A Y Q R E - - - - - - -
SEQ_3   - - E W E N I V A F V V Q P G V E F G - N D F V H E Y K R D - - - - - - -
SEQ_4   - - A W E D V V A V V V Q A G V E F G - V E D I H E Y D H Q - - - - - - -
SEQ_5   - - V F D Y V V A V V A N F G V E F G - S D E I V D F D M E - - - - - - -
SEQ_7   - - A W P A F V - - V A Q V G T D L H - - - - T T Y F D P S - - - - - - -
SEQ_8   - - - H P V F V - - V G D I G T R L D - - - - T R T F D F E - - - - - - -
SEQ_9   - - - Y P Q V L A I A N - - - - - - G - S A H G N T Y D S Q G R L I E Q V
SEQ_10  - - A W E D V V A V V V Q P G V E F G - V E N I H E Y D H Q - - - - - - -
SEQ_11  - - V W N R V I G V V V Q P G V E F G - D E S V H E Y N R E - - - - - - -
SEQ_12  - - A W G R V I A V V V Q P G V E F G - N E H I F E Y D R N - - - - - - -
SEQ_13  - - A W D N V I G V V V Q P G V E E K - D S G C T E Y D R E - - - - - - -
SEQ_14  - - A F N Y V V G V V V Q P G V E F S - S D T V W K Y E R E - - - - - - -
SEQ_15  - - A W E R V I A V V V Q P G V E F G - D E Q V H P Y D R A - - - - - - -
SEQ_16  - - I W P R I I G L V V Q P G V E F D - H A H V C D Y Q P H - - - - - - -
SEQ_17  - - A W D R V I A I V V R L G I G F G - G D S V S E Y E S E - - - - - - -
SEQ_18  - - I W D R I I G F V I M L G I G F N - Y E K V F E Y D R I - - - - - - -
SEQ_19  - - - H P I F V - - V G D I G T R L D - - - - T R T F D F E - - - - - - -
SEQ_20  - - - R P V F V - - V G D I G T R L D - - - - T H T F D F E - - - - - - -
SEQ_21  - - - M P T F I - - V G Q T G T L V R K T E Q A G R F S F E - - - - - - -
SEQ_22  - - - K P S F I - - V G Q T G T L T R L T E N V G N F N T K - - - - - - -
SEQ_23  - - - Y P Q V L A I A N - - - - - - G - S A H G N T Y D E Y G H L I E Q V
SEQ_321 K T L A L R F S G - E W Q K G I D Y I G D - - M E M F R K E - - - - - - -
SEQ_322 R T L A L R F P G - E W Q K G I D Y V G D - - I D L F S E N - - - - - - -
SEQ_323 Q T L A L R F V G - Q W Q K A I D Y I G D - - L S V L E S E - - - - - - -
SEQ_324 I S L A P R F V G - R L E K G V D Y I G D - - L E E F E A H - - - - - - -
SEQ_325 N S M A P R F C G - E F Q K G I D Y I G D - - I H Q F E K E - - - - - - -
SEQ_326 V S L A P R F I G - D F E K G I D Y K G D - - L N V F K T E - - - - - - -
SEQ_327 V S L A P R F C G - E F Q K G I D Y I G D - - V E Q F E V E - - - - - - -
SEQ_328 T S L A P R F C G - E F Q K G I D Y I G D - - L K Q F T D E - - - - - - -
SEQ_329 V G L A P R F V G - R F E K G V D Y R G D - - L G E L K A D - - - - - - -
SEQ_330 K S L A P K F P G - E F Q K G I D Y I G D - - I K E F E R A - - - - - - -
SEQ_331 V S L A P R F V G - K F Q K G V D Y M G N - - L A E F E A E - - - - - - -
SEQ_332 W S L A P R F P G - V F E K A V D Y E G E - - V E R F A Q A - - - - - - -
SEQ_333 F S I A P K F P G - E F E K A V D Y I G D - - L D E F L L E - - - - - - -
SEQ_334 D T L A P R F P G - E F Q K A I D Y I G N - - I Q E F K K S - - - - - - -
SEQ_335 R T I A P K F S G - A F Y K G V D Y V G D - - P H T F A R E - - - - - - -
SEQ_336 D F I A P N V - - - G F R K R E D Y S G D - - L H A L Y E R - - - - - - -
```

FIG. 17 CONTINUED

```
AS MUT
S/E MUT
L/C ONLY
L/C MUT
RESNUM    202 203 204 205 206 207 208 209 210 211 212 213 214 215 216 217 218 219 220 221 222 223 224 225 226 227 228

SEQ_337 I S L A P R F V G - R L E K G V D Y I G D - - L E E F E A H - - - - - - - -
SEQ_338 K S L A P K F P G - E F Q K G I D Y I G D - - I K K F E N E - - - - - - - -
SEQ_339 W S L A P K F P G - E F Q K A I D Y K G D - - I K K F T S G - - - - - - - -
SEQ_340 W S L A P K F P G - E F Q K A I D Y K G D - - I N K F A V E - - - - - - - -
SEQ_341 W S L A P K F P G - E F Q K A I D Y K G D - - I N K F A V E - - - - - - - -
SEQ_342 F S I A P K F P G - E F E K A V D Y I G D - - L D E F S L E - - - - - - - -
SEQ_343 F S I A P K F P G - E F E K A V D Y I G D - - L D E F L L E - - - - - - - -
SEQ_344 F S I A P K F P G - E F E K A V D Y I G D - - L D E F L L E - - - - - - - -
SEQ_345 F S I A P K F P G - E F E K A V D Y I G D - - L D E F L L E - - - - - - - -
SEQ_346 F S I A P K F P G - E F E K A I D Y V G D - - V N E F E R E - - - - - - - -
SEQ_347 D T L A P R F P G - E F Q K A I D Y I G N - - L Q E F K K S - - - - - - - -
SEQ_348 F S I A P K F P G - E F E K A I D Y V G D - - V D E F K K A - - - - - - - -
SEQ_349 D T L A P R F P G - E F Q K G I D Y I G N - - I Q E F K K S - - - - - - - -
SEQ_350 R T I A P K F S G - S F Y K G V D Y V G D - - P E V F A R E - - - - - - - -
SEQ_351 E F I A P N I - - - G F R K R E D Y R G D - - L Q E L Y N R - - - - - - - -
SEQ_352 T N L A L R F I G - E W E K G I D Y K G D - - L A Q F E R E - - - - - - - -
SEQ_353 W S L A P K F P G - E F Q K A I D Y I G D - - V D K F A V E - - - - - - - -
SEQ_354 Q N L A P H F I G - D W E K G I D Y I G N - - I D T F K E E - - - - - - - -
SEQ_355 T S L A P R F C G - E F Q K G I D Y I G D - - L Y Q F E D E - - - - - - - -
SEQ_356 N S L A P R F V G - E F Q K G I D Y I G D - - L E Q F E K E - - - - - - - -
SEQ_357 N S L A P R F V G - E F Q K G I D Y I G D - - L E Q F E K E - - - - - - - -
SEQ_358 N S L A L N F V G - E F Q K G I D Y I G D - - L E K F E K D - - - - - - - -
SEQ_359 E S L A P R F C G - E F Q K G I D Y I G D - - M D Q F E K E - - - - - - - -
SEQ_360 W S L A P K F P G - E F Q K A I D Y I G D - - V D K F A V E - - - - - - - -
SEQ_361 V S L A P R Y V G - T F E K G V D Y I G D - - L D A F E Q S - - - - - - - -
SEQ_362 W S L A P K F P G - E F Q K A I D Y I G D - - V D K F A V E - - - - - - - -
SEQ_363 W S L A P K F P G - E F Q K A I D Y I G D - - V D K F A V E - - - - - - - -
SEQ_364 W S L A P K F P G - E F E K A V D Y R G D - - I D K F T V E - - - - - - - -
SEQ_365 W S L A P K F P G - E F Q K A I D Y K G D - - I K K F T S E - - - - - - - -
SEQ_366 T T M A P R F Y G - E F Q K A I D Y I G D - - K D R F E R E - - - - - - - -
SEQ_367 D T L A P R F P G - E F Q K G I D Y I G N - - V Q E F K K S - - - - - - - -
SEQ_368 D T L A P R F P G - E F Q K G I D Y I G N - - I K E F K N S - - - - - - - -
SEQ_369 D T L A P R F P G - E F Q K A I D Y I G N - - I Q E F K K S - - - - - - - -
SEQ_370 D T L A P R F P G - E F Q K A I D Y I G N - - I Q E F K K S - - - - - - - -
SEQ_371 Q T I A P K F T G - R F N K G V D Y V G D - - I E T F R K E - - - - - - - -
SEQ_372 Q T I A P K F T G - R F N K G V D Y V G N - - L T Q F E R E - - - - - - - -
SEQ_373 D F I A P N V - - - G F Q K R E D F T G D - - L E T L H S R - - - - - - - -
```

FIG. 17 CONTINUED

```
            229                     239
            230                     240
            231                     241
            232                     242
            233                     243
            234                     244
            235                     245
            236                     246
            237                     247
            238                     248
                                    249
                                    250
                                    251
                                    252
                                    253
                                    254
                                    255
RESNUM
SEQ_6    - - - - - K V R G I L E E V K - - - - - R E D L F V E G H S T D Y Q A R Y
SEQ_1    - - - - - R A A A L K D F I E S - - - - H S Q L V Y E A H S T D Y Q T A P
SEQ_2    - - - - - A A R P L K T F I E G - - - - V P G M V Y E A H S T D Y Q T R A
SEQ_3    - - - - - E A K E L T D A L K N - - - - Y K T F V F E G H S T D Y Q T R E
SEQ_4    - - - - - Q A E N L V S A L K K - - - - Y P N L V F E A H S T D Y Q P A K
SEQ_5    - - - - - K V K P L K E L L A K - - - - Y - N I V F E G H S T D Y Q T K E
SEQ_7    - - - - - A A Q R L T E I V R P - - - - T - G A L L K G H Y T D W V E N P
SEQ_8    - - - - - R A R R L D A L V R R - - - - Y - G A L I K G H Y T D D V D R L
SEQ_9    S I D I P Q T I K V A Q A L K E N - - - N L K V R I A Q H G - - - - I T G
SEQ_10   - - - - - Q A E N L V S A L K K - - - - Y P N L V F E A H S T D Y Q P A K
SEQ_11   - - - - - K A E K L V N S L R G - - - - V K G I V F E G H S T D Y Q T K T
SEQ_12   - - - - - R A R E L T E A I K K - - - - H P N I V F E G H S T D Y Q T A K
SEQ_13   - - - - - K A K D L M A S I Q E - - - - F P N L V F E G H S T D Y Q T K I
SEQ_14   - - - - - K A K D L S K A L K E - - - - Y D N L V F E A H S T D Y Q S P K
SEQ_15   - - - - - A A A G L A R A I E P - - - - Y G R L V Y E A H S T D Y Q T R Q
SEQ_16   - - - - - K A V A L S K M V E A - - - - Y D T L L F E A H S T D Y Q T P Q
SEQ_17   - - - - - K T K E L C T Y L S R Y - - - Y P S L Y F E A H S T D Y Q T A G
SEQ_18   - - - - - K V R K I L E E V K - - - - - K E N L F V E G H S T D Y Q T K R
SEQ_19   - - - - - R A C R L D A L V R R - - - - Y - G A L I K G H Y T D D V D R L
SEQ_20   - - - - - R A R R L D A L V R R - - - - Y - G A L I K G H Y T D G V D R L
SEQ_21   - - - - - N A A D L A K M A K K - - - - Y - G V G L K E H N G D Y L D D V
SEQ_22   - - - - - N S K K L A D I A K K - - - - Y - S V G L K E H N G D Y L D E A
SEQ_23   S I D I P Q T M A V A R A L R D N - - - N L N V R I A Q H G - - - - I T G
SEQ_321  - - - I I T H S K I S K E L - - - - - - G G Y K L S L H S G S D - - - -
SEQ_322  - - - L D K H V A I V K M F - - - - - - T G Y R L S L H S G S D - - - -
SEQ_323  - - - L S M H C E I V K S L - - - - - - S G Y R L S L H S G S D - - - -
SEQ_324  - - - L K L H V A I A R T L - - - - - - G P Y K L S L H S G S D - - - -
SEQ_325  - - - F Q V H A E I A D H F - - - - - - G Y K I S I H S G S D - - - -
SEQ_326  - - - Y E K H L D I T K Y F - - - - - - G S Y K I S L H S G S D - - - -
SEQ_327  - - - L R E H A L I A E H F - - - - - - G Y K L S I H S G S D - - - -
SEQ_328  - - - F A V H A A I A D H F - - - - - - G Y K I S V H S G S D - - - -
SEQ_329  - - - L A G H A A L A R S L - - - - - - G P Y K L S L H S G S D - - - -
SEQ_330  - - - L K K H Y A L T K A L - - - - - - E G Y R L S L H S G S D - - - -
SEQ_331  - - - L I R H V A V M R H F - - - - - - H C Y K L S V H T G S D - - - -
SEQ_332  - - - A A L H T A V A R T F - - - - - - G G H R L S L H S G S E - - - -
SEQ_333  - - - L K K H Y Q L S R M I - - - - - - G G Y K I S L H S G S D - - - -
SEQ_334  - - - L I K Q D K I A K Y F - - - - - - G Y R L S I H S G S D - - - -
SEQ_335  - - - F E D D L C V V R Y A R E Q F A L P E G L K L S V H S G S D - - - -
SEQ_336  - - - L R N L H A V V S S M - - - - - - - - N A Y L S I H S G S G S H P Y
```

FIG. 17 CONTINUED

```
AS MUT
S/E MUT
L/C ONLY
L/C MUT
RESNUM            229 230 231 232 233 234 235 236 237 238    239 240 241 242 243 244 245 246 247 248 249 250 251 252 253 254 255
SEQ_337 - - - L K L H V A I A R T L - - - - - - - G P Y K L S L H S G S D - - - -
SEQ_338 - - - L K K Q Y A L T K A L - - - - - - - E G Y R L S L H S G S D - - - -
SEQ_339 - - - L K K H Y F L S K K L - - - - - - - G G Y K L S L H S G S D - - - -
SEQ_340 - - - L K K H Y A I S Q Q L - - - - - - - G G Y K L S L H S G S D - - - -
SEQ_341 - - - L K K H Y A I S Q Q F - - - - - - - G G Y K L S L H S G S D - - - -
SEQ_342 - - - L K K H Y Q L S R M I - - - - - - - G G Y K I S L H S G S D - - - -
SEQ_343 - - - L K K H Y Q L S R M I - - - - - - - G G Y K I S L H S G S D - - - -
SEQ_344 - - - L K K H Y Q L S R M I - - - - - - - G G Y K I S L H S G S D - - - -
SEQ_345 - - - L K K H Y Q L S R M I - - - - - - - G G Y K I S L H S G S D - - - -
SEQ_346 - - - L K K H Y D L T K L I - - - - - - - G G Y K L S L H S G S D - - - -
SEQ_347 - - - L I K Q D K I A K Y F - - - - - - - - G Y R L S I H S G S D - - - -
SEQ_348 - - - L K K H Y D L T K L I - - - - - - - - G G Y K L S L H S G S D - - - -
SEQ_349 - - - L I K Q D K I A K Y F - - - - - - - - G Y R L S I H S G S D - - - -
SEQ_350 - - - F E D D L C V V R Y A R E A F R L P E G L K L S V H S G S D - - - -
SEQ_351 - - - V R K L H T I A S N N - - - - - - - G V Y L S I H S G S G A H P Y
SEQ_352 - - - I K M H A E I A R M F - - - - - - - E G Y K I S L H S G S D - - - -
SEQ_353 - - - L K K H Q F L S R E F - - - - - - - G G Y K L S L H S G S D - - - -
SEQ_354 - - - F K L H C Q I A S Q M - - - - - - - G G Y K L S L H S G S D - - - -
SEQ_355 - - - F K R H A A I A D H F - - - - - - - - G Y R L S I H S G S D - - - -
SEQ_356 - - - F K V H A D I A D R F - - - - - - - - G Y K L S I H S G S D - - - -
SEQ_357 - - - F K V H A D I A D R F - - - - - - - - G Y K L S I H S G S D - - - -
SEQ_358 - - - F E I H A D I A D R F - - - - - - - - G Y K L S I H S G S D - - - -
SEQ_359 - - - L K E H A D I A K H F - - - - - - - - G Y K L S I H S G S D - - - -
SEQ_360 - - - L K K H Q F L S R E F - - - - - - - G G Y K L S L H S G S D - - - -
SEQ_361 - - - I A Q H M A V S R T F - - - - - - - G P Y K L S L H S G S D - - - -
SEQ_362 - - - L K K H Q F L S R E F - - - - - - - G G Y K L S L H S G S D - - - -
SEQ_363 - - - L K K H Q F L S R E F - - - - - - - G G Y K L S L H S G S D - - - -
SEQ_364 - - - L N K H C A V A R M L - - - - - - - G G Y R L S L H S G S D - - - -
SEQ_365 - - - L K K H Y F L T K E L - - - - - - - G G Y K L S L H S G S D - - - -
SEQ_366 - - - F V L H E A I A E Y F - - - - - - - - G Y K L S I H S G S D - - - -
SEQ_367 - - - L I K Q E K I A K Y F - - - - - - - - G Y R L S I H S G S D - - - -
SEQ_368 - - - L M K H H K I A S Y F - - - - - - - - G Y R L S I H S G S D - - - -
SEQ_369 - - - L I K Q N K I A K Y F - - - - - - - - G Y R L S I H S G S D - - - -
SEQ_370 - - - L I K Q D K I A K Y F - - - - - - - - G Y R L S I H S G S D - - - -
SEQ_371 - - - Y E A N L M V I D Y A I Q K F G F P P E L K L S I H S G S D - - - -
SEQ_372 - - - F N Q D I L V I A Y A S K E F G L P K N L K L S V H S G S D - - - -
SEQ_373 - - - V K T L H E V A S F F - - - - - - - G S L L S F H S G S G S S P Y
```

FIG. 17 CONTINUED

| RESNUM | 256 257 258 259 260 261 262 263 264 265 266 267 268 | 269 270 271 272 273 274 275 276 277 |
|---|---|---|
| SEQ_6   | A L R N M V E D G V R I L | - - - - - - - - - - - - K V G P A L T A A |
| SEQ_1   | L L R Q M V K D H F A I L | - - - - - - - - - - - - K V G P A L T F A |
| SEQ_2   | S L R A L V E D H F S I L | - - - - - - - - - - - - K V G P A L T F A |
| SEQ_3   | S L K Q M V E D G I A I L | - - - - - - - - - - - - K V G P A L T F A |
| SEQ_4   | L L K E M V R D G F A I L | - - - - - - - - - - - - K V G P E L T F A |
| SEQ_5   | N L K R M V E C G I A I L | - - - - - - - - - - - - K V G P A L T F T |
| SEQ_7   | A D - - Y P R V G M G G A | - - - - - - - - - - - - N V G P E F T A A |
| SEQ_8   | D L - - Y P K A G I G G A | - - - - - - - - - - - - N V G P G L A A I |
| SEQ_9   | T P R E L I H D H F P H G | - - - - - - - - - - - - E I I K G N V G T F Y |
| SEQ_10  | L L K E M V R D G F A I L | - - - - - - - - - - - - K V G P E L T F A |
| SEQ_11  | K L K E M V E D G I A I L | - - - - - - - - - - - - K V G P A L T Y G |
| SEQ_12  | A L K E M V E D G V A I L | - - - - - - - - - - - - K V G P A L T F A |
| SEQ_13  | K L R E L V E D G V G I L | - - - - - - - - - - - - K V G P A L T F A |
| SEQ_14  | S L R E M V L D G F N I L | - - - - - - - - - - - - K V G P A L T F G |
| SEQ_15  | A L R D L V A D H F A I L | - - - - - - - - - - - - K V G P A L T F A |
| SEQ_16  | A L R Q L V K D H F A I L | - - - - - - - - - - - - K V G P A L T F A |
| SEQ_17  | S L K Q M V K D G I R I L | - - - - - - - - - - - - K V G P A L T D A |
| SEQ_18  | A L R D M V E D G V R I L | - - - - - - - - - - - - K V G P A L T A S |
| SEQ_19  | D L - - Y P K A G I G G A | - - - - - - - - - - - - N V G P G L A A I |
| SEQ_20  | D L - - Y P Q A G I G G A | - - - - - - - - - - - - N V G P G L A A I |
| SEQ_21  | I L L A H I P S Q I T A T | - - - - - - - - - - - - N V A P Q Y G T E |
| SEQ_22  | I L L E H P A L G I T A M | - - - - - - - - - - - - N V A P E F G S V |
| SEQ_23  | T P I E M I H N H F P H G | - - - - - - - - - - - - D I I K G N V G T F Y |
| SEQ_321 | - - - - - - - - K F S V Y P I F S E A T | - - - - E G E F H V K T A G T N - |
| SEQ_322 | - - - - - - - - K F S V Y P I L A E K T | - - - - D R T I H V K T A G T S - |
| SEQ_323 | - - - - - - - - K F S V Y R I F T H Y C | - - - - D G K L H V K T A G T S - |
| SEQ_324 | - - - - - - - - K F A L Y P L F A R H A | - - - - G E L F H L K T A G T S - |
| SEQ_325 | - - - - - - - - K F S V F Q T I G R Y T | - - - - E G R F H V K T A G T N - |
| SEQ_326 | - - - - - - - - K F S A Y R V I G S L K | - - - - G A Y T H V K T A G T S - |
| SEQ_327 | - - - - - - - - K F M V F P I I A E Y T | - - - - K G V F H V K T A G T N - |
| SEQ_328 | - - - - - - - - K F K V F P V V G E K T | - - - - N G R Y H L K T A G T N - |
| SEQ_329 | - - - - - - - - K F S V Y P L I A E A T | - - - - G G M V H L K T A G T S - |
| SEQ_330 | - - - - - - - - K F S I Y K I F Y K I T | - - - - E G N F H I K T S G T S - |
| SEQ_331 | - - - - - - - - K F S I Y P I L A R C A | - - - - G E N V H I K T A G T S - |
| SEQ_332 | - - - - - - - - K F R I L P V F R E A T | - - - - G G R F H V K T S G T T - |
| SEQ_333 | - - - - - - - - K F S I Y R I F S D I T | - - - - E K N F H I K T S G T S - |
| SEQ_334 | - - - - - - - - K F S I Y P I I G E V T | - - - - Q G N Y H L K T S G T S - |
| SEQ_335 | - - - - - - - - K F S L Y P L V R E I L S R H P Q E G V H L K T A G T T - |
| SEQ_336 | S D K - - - - - G F G V W G V V G R A T | - - - - G G A V K Y K M S G V L - |

FIG. 17 CONTINUED

| RESNUM | 256-268 | 269-277 |
|---|---|---|
| SEQ_337 | --------KFALYPLFARHA | ----GELFHLKTAGTS- |
| SEQ_338 | --------KFSIYKSFYKIT | ----EGNFHIKTSGTS- |
| SEQ_339 | --------KFSIYKIFNEIT | ----EGNFHIKTSGTS- |
| SEQ_340 | --------KFSIYEIFSEVT | ----QHSFHIKTSGTS- |
| SEQ_341 | --------KFSIYEIFSEVT | ----QHSFHIKTSGTS- |
| SEQ_342 | --------KFSIYRIFSDIT | ----EKNFHIKTSGTS- |
| SEQ_343 | --------KFSIYRIFSDIT | ----EKNFHIKTSGTS- |
| SEQ_344 | --------KFALYRIFSDIT | ----EKNFHIKTSGTS- |
| SEQ_345 | --------KFSIYRIFSDIT | ----EKNFHIKTSGTS- |
| SEQ_346 | --------KFSIYKIFSQTT | ----EKNFHIKTSGTS- |
| SEQ_347 | --------KFSIYPIIGEVT | ----QGNYHLKTSGTS- |
| SEQ_348 | --------KFSIYKIFSQTT | ----ERNFHIKTSGTS- |
| SEQ_349 | --------KFSIYPIIGEVT | ----QGNYHLKTSGTS- |
| SEQ_350 | --------KFSLYPLIKDILSRHPQEGVHLKTAGTT- | |
| SEQ_351 | SDK-----GVGVWSTIGRAT | ----DGLVKYKMSGVL- |
| SEQ_352 | --------KFSVYPAFASAT | ----GGLFHVKTAGTS- |
| SEQ_353 | --------KFSIYKVFSEIT | ----EGEFHIKTSGTS- |
| SEQ_354 | --------KFSVYPIFAEET | ----NGYFHVKTAGTS- |
| SEQ_355 | --------KFSVFPIIGQYT | ----RGRVHIKTAGTN- |
| SEQ_356 | --------KFSVFPIIGRHT | ----QGRVHVKTAGTN- |
| SEQ_357 | --------KFSVFPIIGRHT | ----QGRVHVKTAGTN- |
| SEQ_358 | --------KFSIFPIIGRQT | ----EGRAHIKTAGTN- |
| SEQ_359 | --------KFSVFPIIGKYT | ----DGLLHIKTAGTN- |
| SEQ_360 | --------KFSIYKVFSEIT | ----EREFHIKTSGTS- |
| SEQ_361 | --------KFSIYPIASRVA | ----GDLVHLKTAGTS- |
| SEQ_362 | --------KFSIYKVFSEIT | ----EGEFHIKTSGTS- |
| SEQ_363 | --------KFSIYKVFSEIT | ----EGEFHIKTSGTS- |
| SEQ_364 | --------KFSVYRIFNDAT | ----QHNFHIKTSGTS- |
| SEQ_365 | --------KFSIYKIFNEIT | ----EGNFHIKTSGTS- |
| SEQ_366 | --------KLSVYEIIGRVA | ----KNGWHVKTAGTN- |
| SEQ_367 | --------KFSIYPIIGEVT | ----QGNYHLKTSGTS- |
| SEQ_368 | --------KFSIYPYVSQIT | ----QGNYHLKTSGTS- |
| SEQ_369 | --------KFSIYPIIGEVT | ----QGNYHLKTSGTS- |
| SEQ_370 | --------KFSIYPIIGEVT | ----QGNYHLKTSGTS- |
| SEQ_371 | --------KFSIYPVIKELSQKH-NKGFHLKTAGTT- | |
| SEQ_372 | --------KFSIYPIIKKAIYTH-HAGLHLKTAGTT- | |
| SEQ_373 | SMK-----GKGVHDIIRRAA | ----GGLFKYKISGVY- |

FIG. 17 CONTINUED

```
              278 279 280 281 282 283 284 285 286 287 288   289 290     291 292 293 294 295     296 297 298 299 300 301 302 303 304 305 306
RESNUM
SEQ_6    F  R  R  G  V  F  L  L  S  N  I  -  -  E  D  -  -  -  E  I  I  P  E  -  -  -  R  E  R  S  N  I  K  R  V  I  L
SEQ_1    L  R  E  A  I  F  A  L  A  F  M  -  -  E  K  -  -  -  E  L  L  P  L  H  R  A  L  K  P  S  A  I  L  E  T  L  D
SEQ_2    Y  R  E  A  V  F  A  L  E  H  I  -  -  E  R  -  -  -  E  I  L  -  G  R  Q  D  M  P  L  S  R  L  S  E  V  L  D
SEQ_3    L  R  E  A  L  I  A  L  N  N  I  -  -  E  N  -  -  -  E  L  L  N  N  V  D  S  I  K  L  S  N  F  T  N  V  L  V
SEQ_4    L  R  E  G  L  F  A  L  N  I  I  -  -  E  K  -  -  -  E  L  F  K  D  N  H  D  I  E  M  S  N  F  I  D  I  L  D
SEQ_5    L  R  E  A  L  V  A  L  S  H  I  -  -  E  E  -  -  -  E  I  Y  S  N  -  E  K  E  K  L  S  R  F  R  E  V  L  L
SEQ_7    E  F  E  A  L  E  A  L  E  R  R  -  -  E  Q  -  -  -  R  L  C  A  N  -  R  K  L  Q  P  A  C  F  L  A  A  L  E
SEQ_8    E  F  E  A  L  E  A  L  V  E  E  -  -  A  R  -  -  -  -  -  -  -  -  -  -  R  R  G  L  S  V  T  F  D  Q  A  I  R
SEQ_9    M  N  L  V  W  D  A  F  K  L  F  -  -  E  P  -  -  -  E  L  Y  N  D  I  W  N  W  T  V  E  N  Y  K  Q  K  S  P
SEQ_10   L  R  E  G  L  F  A  L  N  I  I  -  -  E  K  -  -  -  E  L  F  K  D  N  H  D  I  E  M  S  N  F  I  D  I  L  D
SEQ_11   L  R  E  A  L  F  A  L  N  H  I  -  -  E  N  -  -  -  E  I  F  K  Y  R  A  D  I  K  L  S  N  F  I  N  V  L  E
SEQ_12   L  R  E  A  F  F  A  L  S  S  I  -  -  E  K  -  -  -  E  L  F  Y  D  T  P  G  L  -  C  S  N  F  V  E  V  V  E
SEQ_13   M  R  E  G  M  F  A  L  E  N  I  -  -  E  K  -  -  -  E  L  I  Y  G  -  T  D  I  T  P  S  G  F  Q  D  A  L  E
SEQ_14   F  R  E  A  A  F  A  L  N  K  I  -  -  E  E  -  -  -  E  M  F  R  F  R  P  D  I  E  E  S  R  F  I  Q  T  L  D
SEQ_15   F  R  E  A  V  F  A  L  A  A  V  -  -  E  E  -  -  -  E  W  L  A  G  Q  A  G  V  V  L  S  R  L  R  E  E  L  E
SEQ_16   L  R  E  A  L  F  S  L  A  A  I  -  -  E  E  -  -  -  E  L  L  P  A  K  A  -  -  -  S  S  G  L  R  H  V  L  E
SEQ_17   Y  R  R  G  M  F  A  L  N  F  I  -  -  E  K  -  -  -  E  S  I  D  E  -  -  -  E  K  Q  S  R  L  V  E  N  V  L
SEQ_18   F  R  R  G  V  F  L  L  S  S  I  -  -  E  D  -  -  -  E  L  I  S  E  -  -  -  D  K  R  S  N  I  K  K  V  L  L
SEQ_19   E  F  E  A  L  E  V  L  V  D  E  -  -  A  R  -  -  -  -  -  -  -  -  -  -  R  R  G  L  S  V  T  F  D  Q  A  I  R
SEQ_20   E  F  E  A  L  E  A  L  V  A  E  -  -  A  H  -  -  -  -  -  -  -  -  -  -  R  R  K  L  P  V  T  F  D  R  T  I  R
SEQ_21   E  T  R  A  L  L  K  L  A  K  L  -  -  E  E  -  -  -  K  L  K  E  Q  G  L  I  G  Q  P  S  K  V  K  D  V  L  L
SEQ_22   E  T  Q  A  Y  L  K  L  I  E  V  -  -  E  N  -  -  -  N  L  Y  E  H  G  I  I  S  K  K  S  N  L  E  K  V  I  K
SEQ_23   L  N  L  V  W  D  V  L  K  V  F  -  -  E  P  -  -  -  Q  L  Y  G  D  I  W  D  W  T  I  E  N  F  S  E  K  Y  P
SEQ_321  Y  L  E  A  I  R  V  V  A  V  K  -  -  D  P  -  -  -  E  L  Y  R  E  I  H  K  F  A  L  T  K  F  E  Q  D  R  K
SEQ_322  Y  L  E  A  I  R  V  V  A  K  F  -  -  A  P  -  -  -  D  L  Y  R  Q  I  H  K  Y  A  L  S  R  F  D  Q  D  K  A
SEQ_323  Y  L  E  A  I  R  T  V  A  E  A  -  -  S  P  -  -  -  S  L  Y  R  N  I  H  K  Y  A  L  T  C  F  E  K  D  N  T
SEQ_324  Y  L  E  A  L  R  A  V  A  E  L  -  -  D  P  -  -  -  P  L  F  R  E  I  L  D  F  A  R  D  R  Y  E  T  D  R  A
SEQ_325  W  L  E  A  V  R  V  V  A  E  K  -  -  N  P  -  -  -  N  L  Y  R  K  M  H  Q  Y  A  L  E  H  F  D  E  A  R  A
SEQ_326  Y  L  E  A  L  R  V  V  A  A  K  -  -  E  P  -  -  -  A  L  F  R  D  I  L  D  F  C  R  D  L  Y  E  T  E  K  R
SEQ_327  W  L  E  A  I  R  V  I  A  A  T  -  -  N  P  -  -  -  D  L  Y  R  R  M  H  V  F  A  L  E  N  F  E  E  A  L  K
SEQ_328  W  L  E  A  V  R  V  I  A  R  H  -  -  K  P  -  -  -  D  L  Y  R  R  M  H  A  F  A  L  E  H  L  E  D  A  K  K
SEQ_329  Y  L  E  A  L  R  V  A  A  Q  V  -  -  A  P  -  -  -  G  L  F  R  E  I  L  T  L  G  R  E  R  F  A  V  D  K  Q
SEQ_330  W  L  E  A  V  K  V  I  A  K  F  -  -  F  P  -  -  -  D  L  F  V  E  L  Y  Q  I  A  L  E  N  L  E  E  S  K  K
SEQ_331  Y  L  E  A  L  R  V  A  A  L  R  -  -  A  P  -  -  -  D  L  F  R  Q  M  L  E  T  G  R  T  C  Y  E  K  D  K  K
SEQ_332  W  L  Q  A  V  R  V  V  A  R  A  -  -  V  P  -  -  -  A  L  F  A  E  L  Y  A  I  A  R  A  H  L  E  E  S  R  R
SEQ_333  W  L  Q  A  I  N  L  I  Y  N  Y  -  -  D  K  -  -  -  E  F  Y  R  E  L  Y  K  I  A  L  E  N  L  E  E  S  K  K
SEQ_334  Y  L  E  A  I  K  V  V  A  Q  K  -  -  D  P  -  -  -  E  F  F  K  K  I  W  Q  T  C  L  D  K  R  E  E  M  D  K
SEQ_335  W  L  E  E  V  A  G  L  A  E  A  -  -  G  G  -  -  -  E  A  L  A  L  A  K  E  I  A  L  T  C  Y  S  M  I  E  E  L  C  A
SEQ_336  V  Q  L  L  L  E  V  M  A  S  Y  P  P  G  S  E  T  R  R  L  Y  E  E  I  Y  S  E  V  V  E  H  L  R  W  V  V  K
```

FIG. 17 CONTINUED

```
            RESNUM: 278 279 280 281 282 283 284 285 286 287 288 289 290 291 292 293 294 295 296 297 298 299 300 301 302 303 304 305 306

SEQ_337 Y L E A L R A V A E L - - D P - - - P L F R E I L D F A R D R Y E T D R A
SEQ_338 W L E A V K T I A R Y - - S P - - - D L F L E L Y H I A L E N L E E S K K
SEQ_339 W L Q A I N I I F E R - - D K - - - D L F N D L Y K I A L D N L E E S K K
SEQ_340 W L Q A V N L I F E K - - N K - - - K L F Y E L Y K I A L N N L E E S K K
SEQ_341 W L Q A V N L I F E K - - D K - - - K L F Y E L Y K I A L N N L E E S K K
SEQ_342 W L Q A I N L I Y N Y - - D K - - - E F Y R E L Y K I A L E N L E E S K K
SEQ_343 W L Q A I N L I Y N Y - - D K - - - E F Y R E L Y K I A L E N L E E S K K
SEQ_344 W L Q A I N L I Y D Y - - D K - - - E F Y R E L Y K I A L E N L E E S K K
SEQ_345 W L Q A V N L I Y K F - - D K - - - E F Y R K L Y K I A L S N L E E S K K
SEQ_346 W L Q A V N L I Y K S - - D K - - - E F Y R E L Y K I A L S N L E E S K K
SEQ_347 Y L E A I K I V A Q K - - D P - - - E F F K K I W K T C L D K R E E M D K
SEQ_348 W L Q A V N L I Y K S - - D R - - - E F Y R E L Y K I A L S N L E E S K K
SEQ_349 Y L E A I K V V A Q K - - D P - - - E F F K K I W Q T C L D K R E E M D K
SEQ_350 W L E E V T G L A E S - - G G E A L A L A K E I A L T C Y S M I E E L C A
SEQ_351 I Q L L L E V M S R F P K G S T V R R V Y E E I Y D A V L D H L K K D I S
SEQ_352 Y L E A V K V I S M V - - N P - - - E L F R E I Y R C T L D H F E E D R K
SEQ_353 W F Q A V N L I F E K - - D K - - - E L F K E L Y Q I A L Y N L E E S K K
SEQ_354 W L E A V K A I V V C - - D P - - - A L Y R E M Y E F A L K C F E K D S F
SEQ_355 W L E A L R V V A R I - - N P - - - A L F R E I Y A F A G E V F G E A K K
SEQ_356 W L E A I R V V A E N - - N P - - - S L Y R D I H A Y A L K K F E A A K E
SEQ_357 W L E A I R V V A E N - - N P - - - S L Y R D I H A Y A L K K F E A A K E
SEQ_358 W L E A I R V V A E N - - D P - - - S L Y R E I H S Y A L K K F E E A K E
SEQ_359 W L E A V R V V A Q E - - N P - - - D L Y R R M H V Y A E E H F E E T L K
SEQ_360 W L Q A V N L I F E K - - D K - - - K L F K E L Y Q I A L Y N L E E S K K
SEQ_361 Y L E A L R A I A A M - - A P - - - D L F R Q I V A F A R E R Y P T D R A
SEQ_362 W L Q A V N L I F E K - - D K - - - E L F K E L Y Q I A L Y N L E E S K K
SEQ_363 W L Q A V N L I F E K - - D K - - - K L F K E L Y Q I A L Y N L E E S K K
SEQ_364 W L Q A L N V I H E K - - D R - - - Q L F K E L Y N I A L D N L E E S K K
SEQ_365 W L Q A I S L I F E K - - D K - - - D L F N D L Y K I A L D N L E E S K K
SEQ_366 W L E A L R V I A H K - - D P - - - E F M V E L Y K Y A Y E H L D D V K D
SEQ_367 F L E A I K V V A Q K - - D P - - - E F F K K I W Q T C L D K R E E M D K
SEQ_368 Y L Q A L K I I A Q K - - A P - - - D F F K E I W K T C L D K R T E M D K
SEQ_369 Y L E A I K V V A Q K - - D P - - - E F F K K I W Q T C L D K R E E M D K
SEQ_370 Y L E A I K V I A Q K - - D P - - - E F F K K I W Q T C L D K R E E M D K
SEQ_371 W L E E V I G L A M A - - G G E A L L F V K N I Y S R A L D N I E K L C A
SEQ_372 W L E E L I G L A S A - - G D E G L R I V Q Q I Y R E T Y Y R F D E L C A
SEQ_373 F E L L M Q L M S R S D I - P S V R R L Y E E I Y D A V I E L L E D Q V K
```

FIG. 17 CONTINUED

```
        AS MUT
       S/E MUT
      L/C ONLY
       L/C MUT
RESNUM         3 3 3 3 3 3 3 3 3 3 3 3 3 3 3 3 3 3 3 3 3 3 3 3 3 3 3 3
               0 0 0 1 1 1 1 1 1 1 1 1 1 2 2 2 2 2 2 2 2 2 2 3 3 3 3 3
               7 8 9 0 1 2 3 4 5 6 7 8 9 0 1 2 3 4 5 6 7 8 9 0 1 2 3 4
SEQ_6   E T M L R D D R Y W R K Y Y K D S - K R L E L D I W Y N - - - - - - - L
SEQ_1   Q T M D K N P A Y W Q K H Y G G T K E E V R F A Q R F S - - - - - - - L
SEQ_2   E V M L N D P R H W Q G Y F A G A P A E Q A L A R R Y S - - - - - - - F
SEQ_3   S E M I N N P E H W K N H Y F G D D A R K K F L C K Y S - - - - - - - Y
SEQ_4   T A M L N N P K Y W E Q Y Y Y G D D N K I R I A R K Y S - - - - - - - Y
SEQ_5   N T M L T C K D H W S K Y F D E N D K L I K S L L Y S - - - - - - - Y
SEQ_7   E A V V A S D - R W R K W L Q P D E I G K P F A E L T P A R - - R R W L V
SEQ_8   R A V V E S G - R W T K W L Q P E E K G Q P F D A L D P E R - - Q R W L V
SEQ_9   D K - - - T D S E I F G K Y S K F A I K Q F F D R I Y S - - - - - - - V
SEQ_10  T A M L N N P K Y - - - - - - - - - - - - - - - - - - - - - - - - - - -
SEQ_11  T S M V E E P T H W K Q H Y H G D A E D I K Y A M R Y S - - - - - - - Y
SEQ_12  R A M L D N P K H W E K Y Y Q G E E R E N R L A R K Y S - - - - - - - F
SEQ_13  A E M L K E G K H W R K H Y Q G T E L E L R M K R K Y S - - - - - - - F
SEQ_14  Y N M V K H P E N W I K H Y S G T S E N I R F S R M Y S - - - - - - - L
SEQ_15  A A M I Q D P T H W R G Y Y R G D E R H Q R L A R R Y S - - - - - - - Y
SEQ_16  N V M L D R P E Y W Q S H Y H G D G N A R R L A R G Y S - - - - - - - Y
SEQ_17  K V M D E Y P R Y W E D Y Y N S V G K T L R L D Q M Y S - - - - - - - Y
SEQ_18  E T M L K D D K Y W R K Y Y K D S - E R L E L D I W Y N - - - - - - - L
SEQ_19  R A V V E S G - R W T K W L Q P E E K G R P F E A L D P E R - - Q R W L V
SEQ_20  Q A V I E S G - R W Q K W L R P E E K G R P F E A L P P E R - - Q R W L V
SEQ_21  Y H S I K S E - R W R K W M V G S Q R E L S V E E I V K D E E L S T E I L
SEQ_22  E E A V K S L - R W K K W M V G D K V N L S I E E V L S D K D L T D L I T
SEQ_23  D K - - - S E N E I F G K Y S K Y A I K E F F D R I Y S - - - - - - - V
SEQ_321 S Y H V T T D - - - - - - - - - - - - - - L S K - - - I P D V D K M K N - - -
SEQ_322 S Y H V T T E - - - - - - - - - - - - - - L S K - - - I P D V D K L E D - - -
SEQ_323 S Y H V T A D - - - - - - - - - - - - - - I N K - - - I P D V D N V E D - - -
SEQ_324 T Y H V S A L - - - - - - - - - - - - - - L E R - - - V P K A S D V P D - - -
SEQ_325 Y Y H V T T D - - - - - - - - - - - - - - I E G - - - I V P L E K V N D - - -
SEQ_326 S Y H V S A D - - - - - - - - - - - - - - I N K - - - V K P A N Q Y S D - - -
SEQ_327 Y Y H V T P D - - - - - - - - - - - - - - L N S - - - F E K L E N V E D - - -
SEQ_328 Y Y H I G A K - - - - - - - - - - - - - - V E N - - - I P A L E T L A D - - -
SEQ_329 S Y H I S A A - - - - - - - - - - - - - - L A R - - - V S E A D T L T D - - -
SEQ_330 A Y K V N I T - - - - - - - - - - - - - - K E E - - - F P K E I K E - - - - -
SEQ_331 T Y F L D C R - - - - - - - - - - - - - - P E R - - - V P P A A T L D D - - -
SEQ_332 D Y P I A L Q - - - - - - - - - - - - - - P E A - - - L P P A L P D - - - - -
SEQ_333 S Y K V L I K - - - - - - - - - - - - - - R E D - - - F C K E P E L - - - - -
SEQ_334 Y Y H L S C D - - - - - - - - - - - - - - P F S - - - V P K - - - - - D - - -
SEQ_335 P Y A A V I D - - - - - - - - - - - - - - I D P E R L P S P G E I E E W S S
SEQ_336 A K A S L Y S - - - - - - - - - - - - - - P E L E T L L - - K R Y E A - - -
```

FIG. 17 CONTINUED

```
RESNUM  307 308 309 310 311 312 313 314 315 316 317 318 319 320 321 322 323   324 325 326 327 328 329 330 331 332 333                 334

SEQ_337  T Y H V S A L - - - - - - - - - - - - - - - L E R - - V P K A S D V P D - - -
SEQ_338  A Y K V S I T - - - - - - - - - - - - - - - K E E - - F P K E I K E - - - - -
SEQ_339  A Y K V L I D - - - - - - - - - - - - - - - R D D - - F P Q T I Q T - - - - -
SEQ_340  A Y K V L I D - - - - - - - - - - - - - - - K D D - - F A E E P N L - - - - -
SEQ_341  A Y K V L I D - - - - - - - - - - - - - - - K D D - - F A E E P N L - - - - -
SEQ_342  S Y K V L I K - - - - - - - - - - - - - - - R E D - - F C K E P E L - - - - -
SEQ_343  S Y K V L I K - - - - - - - - - - - - - - - R E D - - F C K E P E L - - - - -
SEQ_344  S Y K V L I K - - - - - - - - - - - - - - - K E D - - F G K E P E L - - - - -
SEQ_345  S Y K V L I K - - - - - - - - - - - - - - - K D D - - F K D E P E L - - - - -
SEQ_346  S Y K V L I K - - - - - - - - - - - - - - - K D D - - F K D E P E L - - - - -
SEQ_347  Y Y H L S C D - - - - - - - - - - - - - - - P F S - - V P K - - - - - N - - -
SEQ_348  S Y K V L I K - - - - - - - - - - - - - - - K D D - - F K D E P E L - - - - -
SEQ_349  Y Y H L S C D - - - - - - - - - - - - - - - P F S - - V P K - - - - - D - - -
SEQ_350  P Y A A V I D - - - - - - - - - - - - - - - I N P D R L P S P G E I E D W S S
SEQ_351  R G R G L A S - - - - - - - - - - - - - - - E T L R K M I - - E D Y E E - - -
SEQ_352  S Y H I S A D - - - - - - - - - - - - - - - L S K - - V P E V E K V K D - - -
SEQ_353  A Y K V L I D - - - - - - - - - - - - - - - K K D - - F P E N I N L - - - - -
SEQ_354  S Y L L S T D - - - - - - - - - - - - - - - L Q K - - I P N I K E L Q D - - -
SEQ_355  Y Y H V T T D - - - - - - - - - - - - - - - L T R - - L P D V A A M A D - - -
SEQ_356  Y Y H V T T D - - - - - - - - - - - - - - - L D K - - V P E L A R M S D - - -
SEQ_357  Y Y H V T T D - - - - - - - - - - - - - - - L D K - - V P E L A R M S D - - -
SEQ_358  F Y Q V N T D - - - - - - - - - - - - - - - L S K - - V P E L A V M S D - - -
SEQ_359  Y Y H V T P D - - - - - - - - - - - - - - - L D S - - V T P L K E Q P D - - -
SEQ_360  A Y K V L I D - - - - - - - - - - - - - - - K K D - - F P E N I N L - - - - -
SEQ_361  S Y H V S A E - - - - - - - - - - - - - - - L E K - - M P D I A G W P D - - -
SEQ_362  A Y K V L I D - - - - - - - - - - - - - - - K K D - - F P E N I N L - - - - -
SEQ_363  A Y K V L I D - - - - - - - - - - - - - - - K K D - - F P E N I N L - - - - -
SEQ_364  A Y K I S I Y - - - - - - - - - - - - - - - R Q D - - F E E G L D L - - - - -
SEQ_365  A Y K V L I D - - - - - - - - - - - - - - - R D D - - F P Q T I Q T - - - - -
SEQ_366  F Y V F N A Q - - - - - - - - - - - - - - - T D G K - A P K P E N V T V - - -
SEQ_367  Y Y H L S C N - - - - - - - - - - - - - - - P F S - - V P K - - - - - D - - -
SEQ_368  Y Y H L S C D - - - - - - - - - - - - - - - P F S - - V P K - - - - - D - - -
SEQ_369  Y Y H L S C D - - - - - - - - - - - - - - - P F S - - V P K - - - - - D - - -
SEQ_370  Y Y H L S C D - - - - - - - - - - - - - - - P F S - - V P K - - - - - D - - -
SEQ_371  P Y A D V I D - - - - - - - - - - - - - - - I N T D N L P K L S E V N N W T G
SEQ_372  P Y A T V I D - - - - - - - - - - - - - - - I H K D K L P E P N S V Q A W N G
SEQ_373  R K G E L Y D - - - - - - - - - - - - - - - E V L V K R L - - E E H R K - - -
```

FIG. 17 CONTINUED

```
          3 3   3       3 3 3 3 3 3 3 3 3 3 3 3 3 3 3 3 3 3 3 3 3 3 3 3 3
          3 3   3       3 3 4 4 4 4 4 4 4 4 4 5 5 5 5 5 5 5 5 5 5 6 6 6 6
RESNUM    5 6   7       8 9 0 1 2 3 4 5 6 7 8 9 0 1 2 3 4 5 6 7 8 9 0 1 2 3
SEQ_6     L D - - - R - - - - I R Y Y W E Y E D V K M V L N K L F E N F S - E G V D
SEQ_1     S D - - - R - - - - I R Y Y W P F P K V Q K A L R Q L L K N L Q Q I S I P
SEQ_2     S D - - - R - - - - I R Y Y W H H P A A Q E A V R R L L A N L I E T P P P
SEQ_3     S D - - - R - - - - C R Y Y L P T R N V K N S L N L L I R N L E N V K I P
SEQ_4     S D - - - R - - - - C R Y Y L I E N E V R A S M S R L F K N L T N V E I P
SEQ_5     L D - - - R - - - - W R Y Y F E N E S V K S A V Y S L I G N L E N V K I P
SEQ_7     Q T - - - G - - - - A R Y V W T A P K V I A A R E Q L Y A H L S L V Q - -
SEQ_8     A T - - - G - - - - S R Y V W T H P A V L Q A R R E L Y E A L A P W - - -
SEQ_9     N E - - - D - - - - T K R - - - - - - - - - - - - - A I D A M A Y A E - T
SEQ_10    - - - - - - - - - - - - - - - - - - - - - - - - - - - - - - - - - - - -
SEQ_11    S D - - - R - - - - C R Y Y M P T E A V N K A M N I L I E N L E S V E I P
SEQ_12    L D - - - R - - - - L R Y Y W N L P E V R T A V N K L I T N L E T K E I P
SEQ_13    S D - - - R - - - - C R Y Y M P T P A V E A A K E R L I S N L R T L G I P
SEQ_14    S D - - - R - - - - C R Y Y M P N E E V E Y S F N K M I N N L D K E E I P
SEQ_15    S D - - - R - - - - A R Y Y W P R P S V Q A A L E R L L H N L E A A P P P
SEQ_16    S D - - - R - - - - V R Y Y W P D S Q I D D A F E R L V R N L A D E P I P
SEQ_17    F D - - - R - - - - I R Y Y W G F E E V E K S K N R L I E N L K - - D M Q
SEQ_18    L D - - - R - - - - I R Y Y W E Y K E I K I A L N R L F E N F S - E G V D
SEQ_19    A T - - - G - - - - S R Y V W T H P A V L Q A R R E L Y E A L A P W - - -
SEQ_20    A T - - - G - - - - S R Y V W T H P A V R Q A R H Q L Y Q V L A P W - - -
SEQ_21    D I - - - A - - - - G H Y T F N I D E V K E E I N K L Y R N L S K A H - -
SEQ_22    E I - - - S - - - - G H Y T F N N E R V K C E I Q L M F D N L N K A G - -
SEQ_23    G D - - - D - - - - T I R - - - - - - - - - - - - - A V E S R A Y A D - T
SEQ_321   E E - - - - - - - - L V K L L D M P D S R Q L I H I T Y G S V L - - - - -
SEQ_322   S E - - - - - - - - L P S L L D Q P D S R Q L I H I T Y G S V L - - - - -
SEQ_323   S K - - - - - - - - V V N L L D I P E V R Q L I H I T Y G S V L - - - - -
SEQ_324   D A - - - - - - - - L P A L L E Q F D T R Q V L H V T F G S V L - - - - -
SEQ_325   H E - - - - - - - - L S Q Y M N E N N A R Q L L H I T Y G I L L - - - - -
SEQ_326   T E - - - - - - - - L I E L F N Q N D T R Q V L H V T F G K V L - - - - -
SEQ_327   A K - - - - - - - - L P E Y M N N D A A R Q L F H V T Y G L L L - - - - -
SEQ_328   S E - - - - - - - - L P E L M N R D D S R Q V M H I T Y G H I L - - - - -
SEQ_329   D E - - - - - - - - L P R L L D D D A R Q V L H V T F G S A L - - - - -
SEQ_330   - D - - - - - - - - Y M E F L H K D N V R Q L F H I S Y G V L L - - - - -
SEQ_331   A D - - - - - - - - L P N L L D Q F D A R Q L L H V T F G S I L - - - - -
SEQ_332   - D - - - - - - - - P E A A L A D R A V R Q L F H I S Y G V L L - - - - -
SEQ_333   - N - - - - - - - - N P K F I L K P E I K Q L F H I S F G V L L - - - - -
SEQ_334   L S - - - - - - - - P T E Y L Q N P D A R Q T L H V S Y M F V L - - - - -
SEQ_335   G R F V E A L E H D P S N P S Y N R D F R Q L I H V G Y K V A A - - - - - -
SEQ_336   A Q - - - - - - - - - - D R F D P R A D V F R H Y - F Y V F Q - - - - -
```

FIG. 17 CONTINUED

```
RESNUM    335 336 337           338 339 340 341 342 343 344 345 346 347 348 349 350 351 352 353 354 355 356 357 358 359 360 361 362 363
SEQ_337   D   A   - - - - - - - -   L   P   A   L   L   E   Q   F   D   T   R   Q   V   L   H   V   T   F   G   S   V   L   - - - - -
SEQ_338   -   D   - - - - - - - -   Y   I   E   F   L   K   K   P   N   V   R   Q   L   F   H   I   S   Y   G   V   L   L   - - - - -
SEQ_339   -   E   - - - - - - - -   D   S   Q   I   L   L   K   P   E   I   K   Q   L   F   H   I   S   Y   G   V   L   L   - - - - -
SEQ_340   -   E   - - - - - - - -   N   V   Q   I   L   S   Q   P   E   I   K   Q   L   F   H   I   S   Y   G   V   L   L   - - - - -
SEQ_341   -   E   - - - - - - - -   N   A   Q   I   L   S   Q   P   E   I   K   Q   L   F   H   I   S   Y   G   V   L   L   - - - - -
SEQ_342   -   N   - - - - - - - -   N   P   N   F   I   L   K   P   E   I   K   Q   L   F   H   I   S   F   G   V   L   L   - - - - -
SEQ_343   -   N   - - - - - - - -   N   P   K   F   I   L   K   P   E   I   K   Q   L   F   H   I   S   F   G   V   L   L   - - - - -
SEQ_344   -   N   - - - - - - - -   N   P   K   F   I   L   K   P   E   I   K   Q   L   F   H   I   S   F   G   V   L   L   - - - - -
SEQ_345   -   D   - - - - - - - -   N   P   E   F   T   L   R   P   E   I   K   Q   L   F   H   I   S   F   G   V   L   L   - - - - -
SEQ_346   -   D   - - - - - - - -   N   S   E   F   I   I   R   P   E   I   K   Q   L   F   H   I   S   F   G   V   L   L   - - - - -
SEQ_347   L   S   - - - - - - - -   P   T   E   Y   L   Q   N   P   D   A   R   Q   T   L   H   V   S   Y   M   F   V   L   - - - - -
SEQ_348   -   D   - - - - - - - -   N   P   E   F   I   V   R   P   E   I   K   Q   L   F   H   I   S   F   G   V   L   L   - - - - -
SEQ_349   L   S   - - - - - - - -   P   T   E   Y   L   K   N   P   D   A   R   Q   T   L   H   V   S   Y   M   F   V   L   - - - - -
SEQ_350   G   R   F V E A L E H D P   S   N   P   S   Y   N   R   D   F   R   Q   L   I   H   V   G   Y   K   V   A   A   - - - - -
SEQ_351   H   S   - - - - - - - - -   -   N   K   Y   D   V   R   A   D   V   F   R   H   Y   -   F   F   V   F   Q   - - - - -
SEQ_352   E   D   - - - - - - - -   L   P   G   L   F   E   D   I   N   V   R   Q   L   I   H   V   T   Y   G   S   V   L   - - - - -
SEQ_353   -   E   - - - - - - - -   D   S   Q   I   V   S   K   P   E   I   K   Q   L   F   H   I   S   Y   G   V   L   L   - - - - -
SEQ_354   K   E   - - - - - - - -   L   I   Q   L   F   S   N   N   A   R   Q   L   I   H   I   T   Y   G   S   I   L   - - - - -
SEQ_355   D   G   - - - - - - - -   L   P   T   V   L   D   H   N   D   A   R   Q   M   L   H   I   T   Y   G   L   V   L   - - - - -
SEQ_356   Q   E   - - - - - - - -   L   G   E   L   L   E   I   N   E   V   R   Q   L   L   H   I   T   Y   G   F   I   L   - - - - -
SEQ_357   Q   E   - - - - - - - -   L   G   E   L   L   E   I   N   E   V   R   Q   L   L   H   I   T   Y   G   F   I   L   - - - - -
SEQ_358   Q   E   - - - - - - - -   L   G   E   L   L   E   I   D   A   V   R   Q   L   L   H   I   T   Y   G   F   I   L   - - - - -
SEQ_359   D   Q   - - - - - - - -   L   P   E   Y   M   N   H   D   A   A   R   Q   L   F   H   V   T   Y   G   I   L   L   - - - - -
SEQ_360   -   E   - - - - - - - -   D   S   Q   I   V   S   K   P   E   I   K   Q   L   F   H   I   S   Y   G   V   L   L   - - - - -
SEQ_361   D   R   - - - - - - - -   L   P   E   L   L   N   D   F   H   A   R   E   I   L   H   V   T   F   G   S   V   L   - - - - -
SEQ_362   -   E   - - - - - - - -   D   S   Q   I   V   S   K   P   E   I   K   Q   L   F   H   I   S   Y   G   V   L   L   - - - - -
SEQ_363   -   E   - - - - - - - -   D   S   Q   I   V   S   K   P   E   I   K   Q   L   F   H   I   S   Y   G   V   L   L   - - - - -
SEQ_364   -   D   - - - - - - - -   N   L   H   V   L   Q   N   P   K   V   K   Q   L   L   H   I   S   Y   G   V   L   L   - - - - -
SEQ_365   -   E   - - - - - - - -   D   S   Q   I   L   S   K   P   E   I   K   Q   L   F   H   I   S   Y   G   V   L   L   - - - - -
SEQ_366   D   N   - - - - - - - -   V   V   D   V   L   S   D   D   D   G   R   Q   V   L   H   T   M   Y   G   S   L   M   - - - - -
SEQ_367   L   S   - - - - - - - -   P   T   E   Y   L   K   N   P   D   A   R   Q   T   L   H   V   S   Y   M   F   V   L   - - - - -
SEQ_368   L   K   - - - - - - - -   P   I   E   Y   L   N   N   P   D   A   R   Q   T   L   H   V   S   Y   M   F   V   L   - - - - -
SEQ_369   L   S   - - - - - - - -   P   T   E   Y   L   K   N   I   D   A   R   Q   T   L   H   V   S   Y   M   F   V   L   - - - - -
SEQ_370   L   S   - - - - - - - -   P   T   E   Y   L   Q   N   P   D   A   R   Q   T   L   H   V   S   Y   M   F   V   L   - - - - -
SEQ_371   E   E   F A N A L R H V P   D   H   P   M   Y   N   P   D   L   R   Q   L   I   H   V   A   Y   K   L   A   A   - - - - -
SEQ_372   E   T   Y A A A L R H I E   N   H   P   Q   Y   N   P   H   F   R   Q   L   L   H   V   G   Y   K   V   A   A   - - - - -
SEQ_373   K   S   - - - - - - - -   L   N   G   Y   V   R   D   S   E   S   P   V   F   R   Y   Y   -   S   F   L   A   L   - - - - -
```

FIG. 17 CONTINUED

```
RESNUM     364 365 366 367 368 369 370 371 372 373  374 375 376 377 378 379 380 381 382 383 384 385 386 387 388 389 390 391 392 393 394 395 396 397 398 399
SEQ_6      I   K   F   I   Y   Q   Y   F   Y   D    -   S   Y   F   D   V   R   E   G   K   M   K   N   D   P   R   E   L   I   K   K   E   I   K   R   V   L
SEQ_1      L   T   L   V   S   Q   F   M   P   E    -   E   Y   Q   R   I   R   Q   G   T   L   T   N   D   P   Q   A   L   I   L   N   K   I   Q   S   V   L
SEQ_2      L   S   L   L   S   Q   Y   L   P   R    -   E   Y   E   M   V   R   A   G   E   I   S   S   H   P   Q   D   L   I   R   A   H   I   Q   H   T   L
SEQ_3      M   T   L   I   S   Q   F   M   P   L    -   Q   Y   D   N   I   R   R   G   L   I   K   N   E   P   I   S   L   I   K   N   A   I   M   N   R   L
SEQ_4      L   T   L   I   S   Q   Y   M   P   I    -   Q   Y   E   K   I   R   M   G   L   L   K   N   D   P   E   N   L   V   K   D   K   I   G   N   C   I
SEQ_5      P   W   L   V   S   Q   Y   F   P   S    -   Q   Y   Q   K   M   R   K   K   D   L   K   N   G   A   A   D   L   I   L   D   K   I   G   E   V   I
SEQ_7      -   -   -   -   -   -   -   -   -   -    -   -   -   -   -   -   -   -   -   -   A   D   P   H   A   Y   V   V   E   S   V   A   R   S   I
SEQ_8      -   -   -   -   -   -   -   -   -   -    -   -   -   -   -   -   -   -   -   -   L   D   A   D   A   F   V   R   T   R   I   K   A   R   L
SEQ_9      L   Y   F   L   K   S   F   N   A   E    R   T   A   S   I   V   R   D   G   I   K   -   -   -   -   -   -   -   -   -   -   -   -   -   -   -   -
SEQ_10     -   -   -   -   -   -   -   -   -   -    -   -   -   -   -   -   -   -   -   -   -   -   -   -   -   -   -   -   -   -   -   -   -   -   -   -   -
SEQ_11     L   T   I   I   D   Q   Y   M   P   M    -   Q   Y   K   K   I   R   E   G   L   I   Q   N   K   P   K   E   L   I   K   D   R   I   G   D   Y   I
SEQ_12     L   T   L   I   S   Q   F   M   P   M    -   Q   Y   Q   K   I   R   N   G   L   L   R   K   D   P   I   S   L   I   K   D   R   I   T   L   V   L
SEQ_13     L   N   L   L   S   Q   F   M   P   I    -   Q   Y   T   K   V   R   E   G   L   L   V   N   D   P   V   E   L   V   E   D   R   I   I   N   T   I
SEQ_14     I   A   L   I   S   Q   Y   M   H   N    -   Q   Y   K   K   V   R   D   G   E   L   K   P   K   G   L   N   L   L   K   D   F   I   G   E   Y   V
SEQ_15     L   T   L   L   S   Q   Y   L   P   V    -   Q   Y   W   S   V   R   E   G   L   L   E   P   T   P   R   S   L   I   V   D   K   I   I   Q   V   L
SEQ_16     L   P   L   I   S   Q   Y   L   P   L    -   Q   Y   G   K   V   R   E   G   A   L   K   S   T   P   R   E   L   I   I   D   H   I   Q   D   I   L
SEQ_17     M   N   L   I   R   Q   Y   L   P   E    -   Q   Y   E   K   I   R   E   N   K   L   N   K   D   P   R   A   L   I   N   Y   E   I   K   K   V   L
SEQ_18     I   R   Y   I   Y   Q   Y   F   Y   D    -   S   Y   F   K   V   R   E   G   K   I   R   N   D   P   R   E   L   I   K   N   E   I   K   K   V   L
SEQ_19     -   -   -   -   -   -   -   -   -   -    -   -   -   -   -   -   -   -   -   -   L   D   A   D   A   F   V   R   E   R   I   K   A   R   L
SEQ_20     -   -   -   -   -   -   -   -   -   -    -   -   -   -   -   -   -   -   -   -   L   D   A   D   A   F   V   R   A   R   I   K   A   R   L
SEQ_21     -   -   -   -   -   -   -   -   -   -    -   -   -   -   -   -   -   -   -   -   I   D   G   Q   R   F   V   V   D   H   I   K   R   S   I
SEQ_22     -   -   -   -   -   -   -   -   -   -    -   -   -   -   -   -   -   -   -   -   V   D   G   E   K   Y   V   I   N   K   I   K   D   S   I
SEQ_23     L   V   F   L   K   A   F   K   A   A    G   M   A   E   H   V   R   K   N   L   -   -   -   -   -   -   -   -   -   -   -   -   -   -   -   -   -
SEQ_321    -   -   -   -   -   -   -   -   -   -    -   -   -   -   -   -   -   -   -   T   A   K   D   E   N   G   R   W   L   F   K   E   R   I   L   K   V   L
SEQ_322    -   -   -   -   -   -   -   -   -   -    -   -   -   -   -   -   -   -   -   T   A   K   K   -   E   G   R   S   L   F   K   D   R   I   M   R   V   L
SEQ_323    -   -   -   -   -   -   -   -   -   -    -   -   -   -   -   -   -   -   -   T   E   K   I   -   N   G   K   Y   L   F   R   D   E   I   Y   R   I   L
SEQ_324    -   -   -   -   -   -   -   -   -   -    -   -   -   -   -   -   -   -   -   T   A   T   D   A   D   G   R   P   R   F   R   D   R   L   L   A   V   L
SEQ_325    -   -   -   -   -   -   -   -   -   -    -   -   -   -   -   -   -   -   -   Q   A   K   D   A   S   G   Q   Y   L   F   R   E   D   F   F   Y   T   L
SEQ_326    -   -   -   -   -   -   -   -   -   -    -   -   -   -   -   -   -   -   -   T   E   K   D   S   S   G   H   F   L   F   K   D   K   I   M   K   C   L
SEQ_327    -   -   -   -   -   -   -   -   -   -    -   -   -   -   -   -   -   -   -   T   A   K   G   E   N   D   T   F   L   F   R   D   E   F   F   K   T   L
SEQ_328    -   -   -   -   -   -   -   -   -   -    -   -   -   -   -   -   -   -   -   Q   A   K   D   E   N   G   N   P   L   F   K   D   E   L   Y   K   V   L
SEQ_329    -   -   -   -   -   -   -   -   -   -    -   -   -   -   -   -   -   -   -   D   -   -   -   -   -   -   -   R   Y   R   A   P   L   L   R   V   L
SEQ_330    -   -   -   -   -   -   -   -   -   -    -   -   -   -   -   -   -   -   -   D   E   K   R   K   -   -   -   -   -   -   -   -   E   I   Y   D   L   L
SEQ_331    -   -   -   -   -   -   -   -   -   -    -   -   -   -   -   -   -   -   -   T   T   H   G   A   -   -   -   -   -   -   -   -   A   L   R   N   L   L
SEQ_332    -   -   -   -   -   -   -   -   -   -    -   -   -   -   -   -   -   -   -   R   E   R   G   P   -   -   -   -   -   -   -   -   A   I   R   A   L   L
SEQ_333    -   -   -   -   -   -   -   -   -   -    -   -   -   -   -   -   -   -   -   N   L   K   R   K   -   -   -   -   -   -   -   -   E   I   V   D   F   L
SEQ_334    -   -   -   -   -   -   -   -   -   -    -   -   -   -   -   -   -   -   -   N   -   -   -   -   -   P   Q   Y   D   F   R   E   K   F   F   E   I   L
SEQ_335    -   -   -   -   -   -   -   -   -   -    -   -   -   -   -   -   -   -   -   Q   M   G   E   -   -   -   -   -   -   -   -   -   R   F   H   Q   A   L
SEQ_336    -   -   -   -   -   -   -   -   -   -    -   -   -   -   -   -   -   -   -   A   L   R   D   E   G   G   A   R   R   L   R   E   R   L   V   E   H   Y
```

FIG. 17 CONTINUED

```
RESNUM     364 365 366 367 368 369 370 371 372 373 374 375 376 377 378 379 380 381 382 383 384 385 386 387 388 389 390 391 392 393 394 395 396 397 398 399
SEQ_337    - - - - - - - - - - - - - - - - - - T A T D A D G R P R F R D R L L A V L
SEQ_338    - - - - - - - - - - - - - - - - - - D E K R E - - - - - - - E I Y E I L
SEQ_339    - - - - - - - - - - - - - - - - - - D E R R K - - - - - - - E I Y E V L
SEQ_340    - - - - - - - - - - - - - - - - - - D E K K E - - - - - - - E I Y D V L
SEQ_341    - - - - - - - - - - - - - - - - - - D E K K E - - - - - - - E I Y D V L
SEQ_342    - - - - - - - - - - - - - - - - - - D L K R K - - - - - - - E M V D F L
SEQ_343    - - - - - - - - - - - - - - - - - - N L K R K - - - - - - - E I V D F L
SEQ_344    - - - - - - - - - - - - - - - - - - D L K R K - - - - - - - E I V D F L
SEQ_345    - - - - - - - - - - - - - - - - - - D L K G K - - - - - - - E I K D M L
SEQ_346    - - - - - - - - - - - - - - - - - - D L K G K - - - - - - - E I K D M L
SEQ_347    - - - - - - - - - - - - - - - - - - N - - - - - P Q Y D F R E K F F E I L
SEQ_348    - - - - - - - - - - - - - - - - - - D L K G K - - - - - - - E I K D M L
SEQ_349    - - - - - - - - - - - - - - - - - - N - - - - - P Q Y D F R E K F I E I L
SEQ_350    - - - - - - - - - - - - - - - - - - Q M G E - - - - - - - - R F H E A L
SEQ_351    - - - - - - - - - - - - - - - - - - C I R D D S G V R Y L R N R V I E L F
SEQ_352    - - - - - - - - - - - - - - - - - - K D A S - - - - - - - L K E R L F K T L
SEQ_353    - - - - - - - - - - - - - - - - - - E E R K K - - - - - - - Q I F E V L
SEQ_354    - - - - - - - - - - - - - - - - - - R E K D S Q N R Y K F R D R I Y K V L
SEQ_355    - - - - - - - - - - - - - - - - - - T A A N A D G S Y R F K D A L Y E L L
SEQ_356    - - - - - - - - - - - - - - - - - - Q D K K - D G R Y I F R D K L Y K F W
SEQ_357    - - - - - - - - - - - - - - - - - - Q D K K - D G R Y I F R D K L Y K F W
SEQ_358    - - - - - - - - - - - - - - - - - - Q D K K - D G R Y I F R D R L Y K L L
SEQ_359    - - - - - - - - - - - - - - - - - - T A K D D A G N D L F R D E F F D T L
SEQ_360    - - - - - - - - - - - - - - - - - - E E R K K - - - - - - - Q I F E V L
SEQ_361    - - - - - - - - - - - - - - - - - - N - - - - - H P P F R E P F F T A L
SEQ_362    - - - - - - - - - - - - - - - - - - E E R K K - - - - - - - Q I F E V L
SEQ_363    - - - - - - - - - - - - - - - - - - E E R K K - - - - - - - Q I F E V L
SEQ_364    - - - - - - - - - - - - - - - - - - D E K R Q - - - - - - - E I Y E V L
SEQ_365    - - - - - - - - - - - - - - - - - - D E R R K - - - - - - - E I Y E V L
SEQ_366    - - - - - - - - - - - - - - - - - - N L K H - N Y H Y V F R D K F W D I L
SEQ_367    - - - - - - - - - - - - - - - - - - N - - - - - P Q Y D F R E K F F E I L
SEQ_368    - - - - - - - - - - - - - - - - - - N - - - - - P K Y D F R N R F F E I L
SEQ_369    - - - - - - - - - - - - - - - - - - N - - - - - P Q Y D F R E K F F E I L
SEQ_370    - - - - - - - - - - - - - - - - - - N - - - - - P Q Y D F R K K F F E I L
SEQ_371    - - - - - - - - - - - - - - - - - - E N I N - - - - - - - - Q F N S F L
SEQ_372    - - - - - - - - - - - - - - - - - - E L G E - - - - - - - - T Y L K A L
SEQ_373    - - - - - - - - - - - - - - - - - - N I R - R N G E R Y L R N A I V E L Y
```

FIG. 17 CONTINUED

```
AS MUT
S/E MUT          ■
L/C ONLY
L/C MUT ■ ■                            ■ ■
RESNUM  4 4 4 4 4 4           4 4 4
        0 0 0 0 0 0           0 0 0
        0 1 2 3 4 5           6 7 8
SEQ_6   E D Y S Y A - - - - - - - I N - L - - - - - - - - - - - - - - - -
SEQ_1   K Q Y A E A - - - - - - - T Q - I Q N S L T F T Q N Q N S L A M E R L
SEQ_2   E D Y A A A - - - - - - - C G - - - - - - - - - - - - - - - - - -
SEQ_3   N D Y Y Y A - - - - - - - I K - P - - - - - - - - - - - - - - - -
SEQ_4   D K Y L Y A - - - - - - - T N - P T S G E F K L I - - - - - - - -
SEQ_5   D H Y V Y A - - - - - - - V K - E - - - - - - - - - - - - - - - -
SEQ_7   E R Y I D A - - - - - - - F N - L Y D A A T L L G - - - - - - - -
SEQ_8   M D Y F R A - - - - - - - F N - L I H F N E R L Q A F L P E - - - -
SEQ_9   - - - - - - - - - - - - - - - - - - - - - - - - - - - - - - - - -
SEQ_10  - - - - - - - - - - - - - - - - - - - - - - - - - - - - - - - - -
SEQ_11  D D Y L Y A - - - - - - - L R - - - - - - - - - - - - - - - - - -
SEQ_12  D D Y Y F A - - - - - - - T H - P E C - - - - - - - - - - - - - -
SEQ_13  D E Y L Y A - - - - - - - T H - Q K E L L - - - - - - - - - - - -
SEQ_14  D D Y I F A - - - - - - - V E - D K - - - - - - - - - - - - - - -
SEQ_15  N D Y T W A - - - - - - - C G - G - - - - - - - - - - - - - - - -
SEQ_16  Q Q Y H A A - - - - - - - C E - G V T T Q N A - - - - - - - - - -
SEQ_17  N D Y Q K S - - - - - - - V I - L E - - - - - - - - - - - - - - -
SEQ_18  E D Y H Y A - - - - - - - V N - L - - - - - - - - - - - - - - - -
SEQ_19  M D Y F R A - - - - - - - F N - L I H F N E R L Q A F L P E - - - -
SEQ_20  M D Y F R A - - - - - - - F N - L I G F N E R L Q A F L P N - - - -
SEQ_21  R N Y V E C - - - - - - - F N - L K G L T S R I K E K L N G S K N A -
SEQ_22  D K Y I K Y - - - - - - - F N - L E G F T T K V L S N V - - - - - -
SEQ_23  - - - - - - - - - - - - - - - - - - - - - - - - - - - - - - - - -
SEQ_321 Q E N E D L - - - H Y D F V E K H - M R K H L S L L G L E R R I E K - - -
SEQ_322 F E H E A E - - - H Y D F L K K H - L G K H I Q L L G V - - - - - - - -
SEQ_323 H E N E F L - - - H Y K R I R D H - L G K H L E L L K N - - - - - - - -
SEQ_324 Q E N E E T - - - Y Y R L L E A H - F D R H L A P F D A E - - - - - - -
SEQ_325 E Q H E A E - - - Y D E A L R K H - I G R H L E Q L G K - - - - - - - -
SEQ_326 V E N E E S - - - H Y E F L E K H - F L K H L E C F K - - - - - - - - -
SEQ_327 D K Y E E E - - - Y R D A L V S H - I G K H I E L L G L - - - - - - - -
SEQ_328 Y E Y E E E - - - Y A N A L K K H - I G R H L E G L G L L - - - - - - -
SEQ_329 E A H D E A - - - Y Q A G L A A H - F A K H L T P F A E V A P - - - - -
SEQ_330 N Q K E K E - - - H Y Q Y V S E N - I K K H L K N L F E E E - - - - - -
SEQ_331 A T Y P N D - - - Y R S A L R D H - F A R H I Q P F V Q A - - - - - - -
SEQ_332 E A H E A E - - - H F T A V R E N - L E R H L E A L L K - - - - - - - -
SEQ_333 N K Y E E E - - - H Y K M V S K N - I D N H L K E I F Y K N - - - - - -
SEQ_334 T K Y Q N E - - - Y H E N V A N H - I E K H V K E L K I E E K S - - - -
SEQ_335 E A H R E V - - - I A A R V T R N L L E R H I I P L F P G D I P - - - -
SEQ_336 R E N P G L R E R Y E K E L - R G L V E R L A S Q L G Y A G N A Y R Y R V
```

FIG. 17 CONTINUED

```
AS MUT
S/E MUT
L/C ONLY
L/C MUT
RESNUM    4000 4001 4002 4003 4004 4005        4006 4007 4008

SEQ_337 Q E N E E T - - - Y Y R L L E A H - F D R H L A P F D A K - - - - - - -
SEQ_338 N K N E K E - - - H Y Q Y V S E N - I R K H L K N L F E E E - - - - - - -
SEQ_339 N K Y E E E - - - H Y E F V S K N - I E N H L K E I F N I - - - - - - - -
SEQ_340 D K Y E E E - - - H Y Q F V S A N - I K N H L G K I F N N - - - - - - - -
SEQ_341 D K Y E E E - - - H Y Q F V S A N - I K N H L E K I F N K - - - - - - - -
SEQ_342 N K Y E E E - - - H Y K M V S K N - I D N H L K E I F Y K N - - - - - - -
SEQ_343 N K Y E E E - - - H Y K M V S K N - I D N H L K E I F Y K N - - - - - - -
SEQ_344 N K Y E E E - - - H Y K M V S K N - I D N H L K E I F Y K N - - - - - - -
SEQ_345 N D Y E E E - - - H Y K M V S D N - I E N H L K E I Y Y E K - - - - - - -
SEQ_346 Y D Y E E E - - - H Y K M V S D N - I E N H L K E I F Y E K - - - - - - -
SEQ_347 T K Y Q N E - - - Y H Q N V A N H - I E K H V K E L K V E E K S - - - - -
SEQ_348 Y E H E E E - - - H Y K M V S N N - I E N H L K E I Y Y E K - - - - - - -
SEQ_349 T K Y Q N E - - - Y H Q N A A N H - I E K H V K E L K V E E K I H K Q K N
SEQ_350 E A H R E V - - - I A A R V T R N L L E R H I I P L F P G G A A - - - - -
SEQ_351 N E V K E L R D R Y R E E V - A N L I T R E A E A L G Y I N S V I R Y R K
SEQ_352 E Q N E E L - - - F Y E T V A K H - I K R H V D L L E G - - - - - - - - -
SEQ_353 N K Y E E E - - - H Y E F V R K N - I E N H F K E I F S K - - - - - - - -
SEQ_354 F E N E D I - - - H Y E N V S K H - I R H H L G L L S V - - - - - - - - -
SEQ_355 F D H E D E - - - Y Y A A L E R H - I G R H L E K L T E N L K G - - - - -
SEQ_356 D E Y D K E - - - Y R R A L E R H - I G R H L N K L G F Y K N - - - - - -
SEQ_357 D E Y D K E - - - Y R R A L E R H - I G R H L N K L G F Y K N - - - - - -
SEQ_358 D E Y D K D - - - Y R S G L E R H - I G R H L N K L G F Y K N - - - - - -
SEQ_359 L N K E D A - - - Y R Q A L A H H - I G R H L D L L G L S K K V G I E - -
SEQ_360 N K Y E E E - - - H Y E F V R K N - I E N H F K E I F S K - - - - - - - -
SEQ_361 R T H E E T - - - Y S E M L E R H - F C R H F A P F A G - - - - - - - - -
SEQ_362 N K Y E E E - - - H Y E F V R K N - I E N H F K E I F S K - - - - - - - -
SEQ_363 N K Y E E E - - - H Y E F V R K N - V E N H F K E I F S K - - - - - - - -
SEQ_364 N Q H E A E - - - H Y R Y V S D N - I K K H L E L L K - - - - - - - - - -
SEQ_365 N K Y E E E - - - H Y E F V S K N - I K N H L K E I F N I - - - - - - - -
SEQ_366 L K N Q D L - - - Y D K Y L N I H - I A E H I D L L Q G K Y K T K E E A L
SEQ_367 T K Y Q N E - - - Y H E N V A N H - I E K H V K E L K I E E T I H K Q K K
SEQ_368 T K Y E N E - - - Y H I E V A E H - I K R H V K E L K I P E K I Q N - - -
SEQ_369 T K Y Q N E - - - Y Y E N V A N H - I E K H V K E L K I E E T K - - - - -
SEQ_370 T K Y Q N E - - - Y H E N V A H H - I E K H V K E L K V E E T K - - - - -
SEQ_371 E Q H S E I - - - V G K C V F E N L Y K R H A E R L F V F S N - - - - - -
SEQ_372 E A H E H H - - - I A L Q V K E N L L D R H I R P I F I Q - - - - - - - -
SEQ_373 L E D K G F R E Q V D R E I - S A L T V A F L D S L G F R G N V R L L R -
```

FIG. 17 CONTINUED

|  |  |  |  |  |  |  |  |  |  |  |
|---|---|---|---|---|---|---|---|---|---|---|
| AS MUT |  |  |  |  |  |  |  |  |  |  |
| S/E MUT |  |  |  |  |  |  |  |  |  |  |
| L/C ONLY |  |  |  |  |  |  |  |  |  |  |
| L/C MUT |  |  |  |  |  |  |  |  |  |  |

RESNUM

```
SEQ_6    - - - - - - - - - - -
SEQ_1    - - - - - - - - - - -
SEQ_2    - - - - - - - - - - -
SEQ_3    - - - - - - - - - - -
SEQ_4    - - - - - - - - - - -
SEQ_5    - - - - - - - - - - -
SEQ_7    - - - - - - - - - - -
SEQ_8    - - - - - - - - - - -
SEQ_9    - - - - - - - - - - -
SEQ_10   - - - - - - - - - - -
SEQ_11   - - - - - - - - - - -
SEQ_12   - - - - - - - - - - -
SEQ_13   - - - - - - - - - - -
SEQ_14   - - - - - - - - - - -
SEQ_15   - - - - - - - - - - -
SEQ_16   - - - - - - - - - - -
SEQ_17   - - - - - - - - - - -
SEQ_18   - - - - - - - - - - -
SEQ_19   - - - - - - - - - - -
SEQ_20   - - - - - - - - - - -
SEQ_21   - - - - - - - - - - -
SEQ_22   - - - - - - - - - - -
SEQ_23   - - - - - - - - - - -
SEQ_321  - - - - - - - - - - -
SEQ_322  - - - - - - - - - - -
SEQ_323  - - - - - - - - - - -
SEQ_324  - - - - - - - - - - -
SEQ_325  - - - - - - - - - - -
SEQ_326  - - - - - - - - - - -
SEQ_327  - - - - - - - - - - -
SEQ_328  - - - - - - - - - - -
SEQ_329  - - - - - - - - - - -
SEQ_330  - - - - - - - - - - -
SEQ_331  - - - - - - - - - - -
SEQ_332  - - - - - - - - - - -
SEQ_333  - - - - - - - - - - -
SEQ_334  - - - - - - - - - - -
SEQ_335  - - - - - - - - - - -
SEQ_336  V Y A - - - - - - - -
```

FIG. 17 CONTINUED

```
AS MUT   ┌┬┬┬┬┬┬┬┬┬┬┬┐
S/E MUT  ├┼┼┼┼┼┼┼┼┼┼┼┤
L/C ONLY ├┼┼┼┼┼┼┼┼┼┼┼┤
L/C MUT  └┴┴┴┴┴┴┴┴┴┴┴┘
RESNUM

SEQ_337  - - - - - - - - - - - -
SEQ_338  - - - - - - - - - - - -
SEQ_339  - - - - - - - - - - - -
SEQ_340  - - - - - - - - - - - -
SEQ_341  - - - - - - - - - - - -
SEQ_342  - - - - - - - - - - - -
SEQ_343  - - - - - - - - - - - -
SEQ_344  - - - - - - - - - - - -
SEQ_345  - - - - - - - - - - - -
SEQ_346  - - - - - - - - - - - -
SEQ_347  - - - - - - - - - - - -
SEQ_348  - - - - - - - - - - - -
SEQ_349  - - - - - - - - - - - -
SEQ_350  - - - - - - - - - - - -
SEQ_351  Y E Y S - - - - - - - -
SEQ_352  - - - - - - - - - - - -
SEQ_353  - - - - - - - - - - - -
SEQ_354  - - - - - - - - - - - -
SEQ_355  - - - - - - - - - - - -
SEQ_356  - - - - - - - - - - - -
SEQ_357  - - - - - - - - - - - -
SEQ_358  - - - - - - - - - - - -
SEQ_359  - - - - - - - - - - - -
SEQ_360  - - - - - - - - - - - -
SEQ_361  - - - - - - - - - - - -
SEQ_362  - - - - - - - - - - - -
SEQ_363  - - - - - - - - - - - -
SEQ_364  - - - - - - - - - - - -
SEQ_365  - - - - - - - - - - - -
SEQ_366  A A L E P K T D I S K E Y
SEQ_367  - - - - - - - - - - - -
SEQ_368  - - - - - - - - - - - -
SEQ_369  - - - - - - - - - - - -
SEQ_370  - - - - - - - - - - - -
SEQ_371  - - - - - - - - - - - -
SEQ_372  - - - - - - - - - - - -
SEQ_373  - - - - - - - - - - - -
```

| | 3 4 5 6 7 8 9 10 11 22 25 29 30 32 33 34 35 36 37 49 50 56 59 62 63 64 66 67 70 71 72 75 |
|---|---|
| SEQ_ID_NO_6_pA06238 | L S K D Y L R K K S Y E E F K E K G D Y Q F M E K N F M K K E K E |
| SEQ_ID_NO_283_pA15926 | . R . H . N E P Q P . . . . H R . E . . . . . . . . . . . . . . . |
| SEQ_ID_NO_284_pA15927 | . D A H . G . P F E W R R . . R L H Y P H R . . . R . . R R . L . |
| SEQ_ID_NO_285_pA15928 | . R H Q N N E P V P . R . . . . T N . . . . . . R . . E R Q T . . |
| SEQ_ID_NO_286_pA15929 | E Q H R . N . . Y . . . . . . Q . . . T . . . . . . . . . . . . D |
| SEQ_ID_NO_287_pA15930 | . L V Q W N I . I P W I L T M . F N Y . . . S R D . Y E L Q L . |
| SEQ_ID_NO_288_pA15931 | . R . H . G E P Q E . . . . . . . . . . P . . . . . . . . . . . . |
| SEQ_ID_NO_289_pA15932 | . M V Q N N L P Y P . . . A . . Y N F . . . . . . E . . R R S . . |
| SEQ_ID_NO_290_pA15933 | . L V Q W N I P I . . . . A M . T D Q . . . . . . . . . R S . . |
| SEQ_ID_NO_291_pA15934 | . R . Q . G H . E R . . . . . L H S R . . . . R L . E R R . D |
| SEQ_ID_NO_292_pA15935 | . E L L W N Q P V . . . T . . . . W . F Q . S R D . Y Q . . . |
| SEQ_ID_NO_293_pA15936 | . M V Q . N L P Y P . . . A . . Y N F . . . . . . . . . D S . . |
| SEQ_ID_NO_294_pA15937 | . M L Q . . I N I P . . . A Q . Y D L . . . S R D . E D R . |
| SEQ_ID_NO_295_pA15938 | . E . H . G . . H E . . . . M Q . D E P F S W . R R . E E R R . D |
| SEQ_ID_NO_296_pA15939 | . M L Q . . I N I P . . . H Q . T N . . . S R D . S . . . |
| SEQ_ID_NO_297_pA15940 | . M V Q . N L P Y P W . . T . Q Y N F . . . S R D . E R Q . D |
| SEQ_ID_NO_298_pA15941 | . M H E . G . . F . . . . . . N R H H R . . . . . . . . . . . D |
| SEQ_ID_NO_299_pA15942 | E R H . N . . Q . F E W R R . . T R . E R H R . S R D E Y R R . E . |
| SEQ_ID_NO_300_pA15943 | . D Q R N G Q P W E . R . . Q . . D Q . . . . . A R . Y E R . H R |
| SEQ_ID_NO_301_pA15944 | . E H H . G . P F E . . . . . . L H Y P . . W S R D . F E . R . D |
| SEQ_ID_NO_302_pA15945 | . R F H . N E P I P . . . A M H V H E P W Q . T R D . . T R . . D |
| SEQ_ID_NO_303_pA15946 | . P A H . . . E H R . . . . Q N M H E P . . W S R D . Y . . . . R |
| SEQ_ID_NO_304_pA15947 | . D H H . . L N I P . . . A N M H L P . . . S R D . D D R . D |
| SEQ_ID_NO_305_pA15948 | . D A H . . . D I P . R I . I R T . . . . S R D . S D . L D |
| SEQ_ID_NO_306_pA15949 | T D H N . . . E I E . . . . I . M . S . . . W S R D . F E D R . |
| SEQ_ID_NO_307_pA15950 | . M L Q . . I N I . R I A L R Y D L . . . S A E . Y R Q . I . |
| SEQ_ID_NO_308_pA15951 | . N Q Q . . . R E P . . . . Q . Y N R . . . S R D . F E D R . |
| SEQ_ID_NO_309_pA15952 | . L L Q . . . N I P . . . . . . . . . . . . . R . . E D R . |
| SEQ_ID_NO_310_pA15953 | . M L Q . . I N I P . R . . L . T N . . . . S R E . R Q . I . |
| SEQ_ID_NO_311_pA15954 | . . A Q . . . . . P . . . Q . Y N T . . . . R . . E D R . |
| SEQ_ID_NO_312_pA15955 | T D H . . . R V E . R R . R D D D T . . H . S R D . Y R D . E R |
| SEQ_ID_NO_313_pA15956 | . M L Q . . I N I P . R . Q R T N L . . . . R . . E D R T . |
| SEQ_ID_NO_314_pA15957 | . M L Q . . I N I . . R A Q . Y N L . . . S R D . E D R T . |
| SEQ_ID_NO_315_pA15958 | . P A H . . . E H E . . . . . N M . E . . . W S R D . Y E D R . |
| SEQ_ID_NO_316_pA15959 | T D H A . . . E I E . R R . I . . T . . . . R . . E D . E R |
| SEQ_ID_NO_317_pA15960 | . P A H . . . R R E . . . . . N M . . . . . R . . E D R . R |
| SEQ_ID_NO_318_pA15961 | . M Q A . . . I A I E . R R A Q N Y N T . . . S R D . Y R D . E . |
| SEQ_ID_NO_319_pA15962 | . . H . . . . E H E . R . I N M H . P . . W S R D . Y E D R T . |
| SEQ_ID_NO_320_pA15963 | . P A H . . . E H E . . . . I . M H . P . . . . R . . E D R L . |

| | 76 | 77 | 78 | 80 | 94 | 95 | 96 | 98 | 101 | 102 | 104 | 105 | 108 | 116 | 125 | 129 | 130 | 131 | 132 | 134 | 135 | 136 | 137 | 140 | 141 | 144 | 147 | 148 | 150 | 151 | 152 | 153 | 154 | 155 | 156 |
|---|---|---|---|---|---|---|---|---|---|---|---|---|---|---|---|---|---|---|---|---|---|---|---|---|---|---|---|---|---|---|---|---|---|---|---|
| SEQ_ID_NO_6_pA06238 | E | D | K | I | E | S | T | N | K | K | D | R | K | P | D | P | K | V | P | Y | E | K | E | R | E | E | I | E | E | T | A | R | K | Y | |
| SEQ_ID_NO_283_pA15926 | . | . | . | . | . | . | . | . | . | . | . | . | . | . | . | . | . | . | . | . | . | . | . | . | . | . | . | . | . | . | . | . | . | D | |
| SEQ_ID_NO_284_pA15927 | . | N | M | . | Y | . | W | Q | E | . | E | . | W | . | . | . | S | E | T | . | . | . | . | . | . | . | . | . | . | . | . | . | . | G | F |
| SEQ_ID_NO_285_pA15928 | . | . | R | . | . | . | E | . | R | Q | . | . | . | . | Q | . | E | T | . | . | . | . | . | . | Q | . | . | . | . | R | . | S | P | P | Q |
| SEQ_ID_NO_286_pA15929 | . | . | R | M | . | . | . | . | . | . | . | . | Y | . | . | . | D | R | . | . | . | . | . | . | . | . | . | . | . | . | . | Q | Q | E | T |
| SEQ_ID_NO_287_pA15930 | L | . | M | . | . | L | A | R | T | Y | R | Q | . | L | . | Q | . | E | T | D | W | R | Q | I | Y | . | . | V | . | R | V | . | P | P | V |
| SEQ_ID_NO_288_pA15931 | . | . | . | . | . | . | . | . | . | . | . | . | E | . | . | . | . | . | . | . | . | . | . | . | . | . | . | . | . | . | . | . | . | G | F |
| SEQ_ID_NO_289_pA15932 | . | . | M | . | . | . | A | . | . | . | . | . | . | . | . | Q | . | E | T | D | . | R | I | I | Y | . | . | . | . | . | . | . | P | P | V |
| SEQ_ID_NO_290_pA15933 | . | . | M | . | . | . | A | . | . | . | . | . | . | . | . | Q | . | E | T | D | . | R | Q | I | Y | . | . | . | . | . | . | . | P | P | V |
| SEQ_ID_NO_291_pA15934 | . | R | L | . | . | . | Q | . | R | E | . | . | Y | E | E | . | E | . | . | . | . | . | . | . | . | . | Q | . | . | . | R | Y | R | . | . |
| SEQ_ID_NO_292_pA15935 | L | . | . | . | . | L | A | Q | E | Y | . | I | . | L | A | Q | . | Y | Y | D | . | R | Q | I | Y | . | . | . | . | . | . | . | P | P | V |
| SEQ_ID_NO_293_pA15936 | R | . | M | . | . | . | . | . | . | . | . | . | . | . | . | . | . | . | W | . | . | . | . | . | . | . | . | . | . | . | . | . | P | P | V |
| SEQ_ID_NO_294_pA15937 | R | N | R | . | . | A | . | A | . | E | E | . | T | . | . | . | . | E | T | . | L | . | V | . | . | R | . | V | . | R | . | . | . | E | . |
| SEQ_ID_NO_295_pA15938 | P | . | . | Q | Y | E | Q | Q | W | R | E | . | . | E | . | W | . | . | . | . | . | . | V | . | V | W | . | R | . | . | . | . | . | F | . |
| SEQ_ID_NO_296_pA15939 | . | N | R | . | . | A | . | E | . | R | Q | . | T | . | . | . | . | E | T | . | L | . | V | . | . | . | . | V | . | R | . | . | . | E | . |
| SEQ_ID_NO_297_pA15940 | . | R | M | . | L | . | Q | E | Y | . | E | . | L | . | . | . | . | W | . | . | . | . | . | . | . | . | . | . | . | . | . | . | . | . | . |
| SEQ_ID_NO_298_pA15941 | . | R | L | . | . | R | . | . | R | E | . | . | Y | . | E | . | . | . | . | H | W | S | R | . | D | D | . | E | . | R | R | . | . | . | E |
| SEQ_ID_NO_299_pA15942 | . | . | R | . | Y | . | W | E | E | . | E | . | Y | . | E | . | E | . | . | W | P | . | . | . | . | . | . | . | . | . | . | R | T | Q | F |
| SEQ_ID_NO_300_pA15943 | . | . | R | . | . | . | Q | . | R | E | . | . | Y | . | . | . | . | . | . | W | P | . | . | . | . | . | . | V | . | R | V | . | Q | W | . |
| SEQ_ID_NO_301_pA15944 | L | R | L | . | . | . | . | . | . | . | . | . | . | . | . | . | . | . | . | . | . | . | . | . | . | . | . | . | . | . | . | . | . | . | . |
| SEQ_ID_NO_302_pA15945 | . | R | L | . | . | L | A | Q | T | Y | Q | I | . | L | . | . | . | W | S | E | . | . | . | W | . | L | . | L | . | R | V | . | V | G | Q D M |
| SEQ_ID_NO_303_pA15946 | L | . | L | . | . | L | E | I | Q | Y | R | E | . | . | . | . | . | E | T | D | L | T | R | . | . | . | . | R | E | . | . | . | . | . | . |
| SEQ_ID_NO_304_pA15947 | R | N | L | . | . | L | A | Q | D | Y | R | Q | . | T | . | . | . | E | . | . | L | . | V | . | . | . | . | R | V | . | . | . | . | E | . |
| SEQ_ID_NO_305_pA15948 | R | N | L | . | . | L | A | R | E | Y | R | Q | I | T | . | . | . | E | R | . | L | . | V | R | . | . | . | . | . | R | Y | . | Q | E | . |
| SEQ_ID_NO_306_pA15949 | R | N | L | . | . | L | E | R | R | Y | E | E | . | T | . | . | . | E | . | . | L | . | R | . | . | R | . | V | . | R | Y | Q | Q | . | . |
| SEQ_ID_NO_307_pA15950 | . | N | R | . | . | A | . | . | . | . | . | . | T | . | . | . | . | E | T | . | L | . | V | . | . | . | . | . | . | . | . | . | . | E | . |
| SEQ_ID_NO_308_pA15951 | R | N | R | . | . | . | E | . | . | R | E | . | . | . | . | . | S | E | T | . | . | . | P | R | . | . | I | . | E | . | R | . | . | E | . |
| SEQ_ID_NO_309_pA15952 | R | . | . | . | . | L | A | Q | E | Y | . | E | . | T | . | . | . | . | . | . | L | . | V | . | . | . | . | . | . | . | . | . | . | E | . |
| SEQ_ID_NO_310_pA15953 | . | . | R | . | . | . | . | . | A | . | E | E | . | . | . | . | . | E | T | . | L | . | . | . | . | R | . | V | . | R | . | . | . | E | . |
| SEQ_ID_NO_311_pA15954 | R | N | R | . | . | . | . | . | A | . | E | E | . | . | . | . | . | . | . | . | L | . | . | . | . | R | . | V | . | R | . | . | . | E | . |
| SEQ_ID_NO_312_pA15955 | R | . | L | . | . | R | E | E | . | E | R | E | . | . | . | . | R | . | S | S | . | . | P | R | . | . | . | E | . | R | Y | . | E | Q | . |
| SEQ_ID_NO_313_pA15956 | R | N | R | . | . | L | A | Q | E | Y | . | E | . | . | . | . | . | E | T | . | . | . | V | . | . | . | . | . | . | . | . | . | . | E | . |
| SEQ_ID_NO_314_pA15957 | R | N | R | . | . | A | . | E | . | R | Q | . | T | . | . | . | . | . | . | . | L | . | V | . | . | . | . | V | . | R | . | . | . | . | . |
| SEQ_ID_NO_315_pA15958 | R | . | R | . | . | . | . | . | . | . | . | . | . | . | . | . | . | E | T | . | . | D | . | . | . | . | . | . | . | . | . | . | . | Q | M |
| SEQ_ID_NO_316_pA15959 | R | . | L | . | . | . | E | . | Q | . | R | E | . | T | . | . | . | E | . | D | D | . | R | R | . | . | . | V | . | R | Y | Q | Q | . | . |
| SEQ_ID_NO_317_pA15960 | R | . | L | . | . | . | E | . | . | . | R | E | . | D | . | . | . | E | T | A | L | P | R | . | . | . | . | R | E | . | . | . | . | Q | M |
| SEQ_ID_NO_318_pA15961 | R | N | R | . | . | L | E | Q | Q | Y | R | E | . | T | . | . | . | S | E | T | . | . | P | R | . | . | . | V | . | R | . | . | . | E | . |
| SEQ_ID_NO_319_pA15962 | R | N | L | . | . | . | E | . | Q | . | R | E | . | D | . | . | . | E | T | A | L | P | R | . | . | . | . | R | E | . | . | A | . | . | M |
| SEQ_ID_NO_320_pA15963 | R | N | L | . | L | . | Q | Q | Y | R | E | . | T | . | . | . | . | . | . | . | L | P | . | . | . | . | . | R | E | . | . | . | . | Q | M |

METHODS AND COMPOSITIONS FOR PREPARING TAGATOSE FROM FRUCTOSE

CROSS-REFERENCE TO RELATED APPLICATION

The present application claims priority to, and the benefits of U.S. Provisional Patent Application No. 62/693,681, filed Jul. 3, 2018, and 62/693,660, filed Jul. 3, 2018, each of which is herein incorporated by reference in its entirety.

STATEMENT REGARDING SEQUENCE LISTING

The Sequence Listing associated with this application is provided in text format in lieu of a paper copy, and is hereby incorporated by reference into the specification. The name of the text file containing the Sequence Listing is ARZE_028_01US_SeqList_ST25.txt. The text file is about 1.56 megabytes, was created on Jul. 3, 2019 and is being submitted electronically via EFS-Web.

FIELD OF THE INVENTION

The invention described herein generally relates to the fields of microbiology, biochemistry, and organic chemistry.

BACKGROUND

As problems with obesity and diabetes continue to rise globally, it is of growing importance to have access to alternative low-calorie sweeteners that provide health benefits over traditional sweeteners. D-tagatose is a naturally occurring sweetener that is GRAS (generally recognized as safe) for use in food and beverages. It is 92% as sweet as sucrose and has less than half the caloric value. Importantly, D-tagatose has a taste profile very similar to sucrose and does not have a lingering bitterness characteristic of related alternative sugars such as psicose (allulose). D-tagatose has been suggested to have several positive health benefits including non-tooth decaying, anti-hyperglycemic, and a positive prebiotic effect.

The ketohexose monosaccharide D-tagatose is a C4-epimer of D-fructose. Therefore, D-tagatose is a reducing sugar that undergoes browning reactions and can be used as a "drop-in" replacement for typical bulk sweeteners. There exist established methods to produce D-tagatose from galactose (commonly produced from lactose) using both chemical and biocatalytic means. However, the high cost of generating the galactose feedstock makes the galactose route less attractive than a process that can utilize lower-cost feedstocks such as fructose, glucose, or sucrose.

SUMMARY OF THE INVENTION

The present disclosure provides compositions and methods for producing tagatose by epimerizing fructose at carbon number 4. The present disclosure allows the use of fructose as the source material for tagatose production, which is more economical than using galactose as the source material.

In one aspect, the disclosure provides a polypeptide comprising an amino acid sequence having at least 60% sequence identity to any one of SEQ ID NOs:1-444, wherein the polypeptide has D-fructose C4-epimerase activity. In further embodiments, the polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or at least 99.9% identical to any one of SEQ ID NOs: 1-444, wherein the polypeptide has D-fructose C4-epimerase activity.

In other embodiments, the polypeptide comprises one or more modifications at the amino acid residue corresponding to position L3, S4, K5, D6, Y7, L8, R9, K10, K11, V13, Y14, S15, I16, C17, S18, S19, S21, Y22, E25, S27, E29, F30, K32, E33, K34, G35, D36, Y37, E41, T43, P44, H45, Q46, Q49, F50, Y53, S54, M56, E59, K62, N63, F64, M66, K67, K70, E71, K72, E75, E76, D77, K78, I80, D84, H85, L89, Q92, D93, E94, S96, P97, T98, N101, K102, K104, D105, R108, F110, S113, Y115, K116, K117, H119, D121, C122, S123, M124, P125, L126, S127, D128, D129, P130, K131, V132, P134, Y135, E136, K137, E140, R141, T142, R143, E144, F146, E147, I148, E150, E151, T152, A153, R154, K155, Y156, N157, F158, Q159, P160, V161, T166, D167, V168, P169, I170, A171, G172, G173, G174, E175, E176, E177, G178, V179, V182, D184, S187, A188, I189, S190, S191, L192, K193, K194, Y195, N197, D198, V199, P200, N201, I202, W203, D204, R205, G208, V210, I211, M212, L213, I215, G216, F217, S218, Y219, D220, K221, V222, E224, D228, K229, V230, R231, G232, I233, L234, E235, V237, K238, R239, E240, D241, L242, V244, E245, G246, H247, S248, T249, D250, A253, Y255, A256, R258, N259, E262, R266, K269, V270, G271, P272, A273, R280, G281, V282, L284, S286, N287, D290, E291, I292, E295, R296, E297, S299, N300, K302, R303, E307, D313, Y315, K318, Y319, K321, D322, S323, K324, R325, L326, E327, L328, I330, W331, N333, L334, L335, D336, R337, R339, Y340, E343, Y344, E345, K348, M349, V350, N352, K353, E356, N357, F358, E360, G361, V362, D363, I364, K365, F366, Y368, Q369, Y370, Y372, D373, S374, Y375, F376, D377, R379, E380, K382, M383, K384, N385, D386, R388, E389, K392, K393, K396, R397, E400, S403, N407, or L408 of SEQ ID NO:6; or combinations thereof.

In some embodiments, the polypeptide comprises one or more of modifications: L3E, L3T, S4M, S4D, S4R, S4L, S4Q, S4N, S4E, S4P, K5F, K5M, K5L, K5R, K5W, K5H, K5Q, K5V, K5A, D6R, D6L, D6H, D6Q, D6N, D6A, D6E, Y7W, Y7H, Y7N, L8N, L8G, R9L, R9T, R9H, R9Q, R9E, R9I, K10M, K10D, K10R, K10L, K10V, K10N, K10A, K10E, K10P, K11F, K11L, K11R, K11Y, K11W, K11V, K11Q, K11H, K11E, K11I, V13I, Y14F, S15A, I16V, C17S, C17L, C17R, C17T, C17G, C17V, C17A, C17I, S18N, S18A, S19N, S21K, S21R, S21Q, S21E, S21P, Y22W, E25R, E25I, S27C, S27A, E29Q, E29R, E29I, E29L, F30H, F30T, F30A, K32S, K32M, K32L, K32R, K32Q, K32A, K32I, E33R, E33T, E33H, E33Q, E33N, E33D, K34F, K34S, K34M, K34R, K34L, K34Y, K34T, K34H, K34Q, K34V, K34E, K34D, K34I, G35D, G35N, G35H, G35S, D36F, D36S, D36R, D36L, D36Y, D36T, D36W, D36H, D36Q, D36N, D36E, Y37D, Y37P, Y37R, Y37E, E41Q, E41A, H45F, H45K, H45Q, H45A, Q46S, Q46R, Q46T, Q46W, Q46A, Q49F, Q49H, Q49I, Q49W, F50Q, F50H, F50R, F50S, Y53F, Y53V, Y53S, Y53A, S54T, M56W, E59R, E59S, E59T, K62V, K62R, K62Y, K62A, N63E, N63D, N63R, N63Q, F64E, F64L, M66F, M66E, M66Y, K67S, K67R, K67T, K67Q, K67E, K67D, K70D, K70Q, K70R, K70L, E71Q, E71R, E71S, K72L, K72R, K72T, K72V, K72Q, K72H, K72E, K72I, E75D, E75P, E75R, E75S, E76P, E76L, E76R, D77N, D77R, D75S, K78M, K78R, K78L, K78Q, K78D, I80Q, I80R, I80L, D84P, D84N, D84G, D84A, H85A, L89S, L89G, Q92M, Q92D, Q92G, Q92A, Q92P, D93H, E94Q, E94R, E94Y, E94L, S96E, S96R, S96A, P97E, P97D, T98R, T98W, T98V, T98Q, T98E, T98I, N101S, N101D, N101R, N101T, N101H, N101Q, N101A, N101E, N101K, N102L, N102R, K102Y, K102W, K102Q, K102E, K104F, K104R, K104V, K104Q, K104N, K104E, K104I, D105E, D105Q, D105I, R108I, F110Y, S113A, Y115F, K116S, K116R, K116L, K116Y, K116T, K116W, K116H, K116Q, K116E, K116D, K116I, K117M, K117L, K117R, K117W, K117V, H119S, H119G, H119N, H119A, H119P, D121N, D121A, C122R, C122G, C122T, C122V, C122A, C122E, C122K, S123M, S123R, S123T, S123A, M124K, M124R, P125A, L126C, S127A, D128G, D129R, D129L, D129W, D129Q, D129E, P130S, K131S, K131R, K131L, K131Y, K131Q, K131A, K131E, K131D, V132S, V132R, V132Y, V132T, V132E, P134D, P134H, P134A, Y135K, Y135M, Y135D, Y135L, Y135R, Y135T, Y135W, Y135Q, Y135N, Y135P, E136S, E136R, E136P, E136W, E136T, E136Q, E136D, K137L, K137R, K137T, K137W, K137V, K137Q, K137E, K137I, E140D, E140R, E140I, E140L, R141L, R141Y, R141W, R141H, R141Q, R141D, T142E, R143V, R143A, E144Q, E144D, E144R, E144I, F146C, E147Q, E147K, E147R, E147A, I148E, I148V, I148D, E150R, E150A, E151R, T152R, T152Y, T152V, T152I, T152Q, T152A, A153Q, A153R, A153G, A153S, R154S, R154T, R154Q, R154E, R154P, K155R, K155Y, K155P, K155T, K155H, K155N, K155Q, K155G, K155W, K155E, K155D, Y156F, Y156M, Y156R, Y156T, Y156V, Y156Q, Y156E, Y156D, N157E, N157D, N157R, N157P, F158S, F158L, F158T, F158V, F158N, F158E, Q159R, Q159L, Q159G, Q159T, Q159W, Q159E, P160F, P160S, P160M, P160L, P160R, P160T, P160A, P160E, P160I, V161E, V161I, V161Y, V161W, T166M, T166L, T166I, D167T, D167V, D167Q, D167N, D167A, V168M, V168R, I170M, I170K, I170T, A171P, G173S, E175K, E175V, E175R, E176F, E176Y, G178P, V179R, V179I, V182P, V182K, V182A, D184E, S187R, S187T, S187N, S187Q, S187A, S187E, S187K, A188M, A188F, A188T, I189L, S190E, S190D, S190Y, S191L, S191R, S191Y, S191T, S191W, S191V, S191H, S191Q, S191A, S191E, S191I, L192F, L192H, K193F, K193R, K193L, K193Y, K193Q, K193A, K193E, K193I, K194S, K194R, K194L, K194T, K194Q, K194A, K194E, K194D, Y195H, Y195Q, Y195A, N197S, N197D, N197R, N197L, N197P, N197Q, N197R, N197K, D198K, V199H, V199L, V199I, V199C, P200M, P200L, P200R, P200G, P200E, P200D, N201Q, N201K, N201R, N201E, I202M, I202A, W203F, W203R, W203L, W203Y, W203H, W203A, D204N, D204R, D204S, R205Q, R205L, G208A, V210P, V210T, I211V, M212K, M212L, M212R, L213M, I215V, G216N, G216R, G216T, S218T, S218G, Y219D, Y219H, Y219R, Y219G, D220Q, D220R, D220E, D220T, K221R, K221T, K221V, K221Q, K221E, K221I, V222I, E224M, E224Q, E224Y, D228E, D228S, K229S, K229R, K229T, K229N, K229Q, K229A, K229E, V230A, R231E, R231L, R231F, R231A, G232D, G232R, G232P, G232E, G232K, I233L, L234M, L234A, E235W, E235R, V237L, K238S, K238R, K238W, K238Q, K238E, R239S, E240M, E240Y, E240T, E240V, E240N, E240H, E240D, D241R, D241G, D241Q, D241N, D241P, L242W, V244L, E245Q, E245A, G246C, G246V, G246A, H247A, T249S, D250N, D250A, A253S, A253P, A253T, A253N, A253D, Y255E, Y255D, Y255Q, Y255K, A256L, R258E, R258L, N259R, N259W, N259A, N259E, N259D, E262Q, E262R, E262L, R266V, R266A, K269L, K269E, K269V, K269N, K269I, G271D, G271A, A273W, R280E, G281A, V282I, L284K, S286D, S286V, S286A, N287F, N287R, N287L, N287H, N287Q, N287E, N287D, D290F, D290R, D290Q, D290N, D290A, D290E, D290K, E291D, E291R, I292Q, I292L, I292E, E295P, R296E, R296D, R296Y, E297R, E297L, E297G, E297H, E297Q, E297K, S299Q, S299A, N300E, N300D, N300Q, N300R, K302M, K302L, K302R, K302Q, K302E, K302P, K302I, R303E, R303D, R303Q, E307Q, E307R, D313P, Y315W, K318E, K318D, K318R, K318N, K321S, K321R, K321T, K321H, K321E, K321D, D322T, S323D, S323G, K324S, K324R, K324P, K324W, K324H, K324E, K324D, R325S, R325G, R325W, R325N, R325Q, R325A, R325E, R325D, L326H, E327R, E327I, E327Y, L328F, L328R, L328Y, L328W, L328E, L328D, I330L, W331E, W331H, W331L, W331F, N333A, N333S, L334Y, R339E, R339T, R339A, R339G, Y340F, Y340R, Y340H, Y340A, Y340P, E343M, E343L, E343Y, E343Q, E343N, E343D, Y344H, E345D, E345P, K348R, K348L, K348Y, K348W, K348V, K348Q, K348A, K348E, M349R, M349Y, M349C, M349T, M349W, M349N, M349Q, M349A, M349E, M349K, M349I, V350A, N352M, N352R, N352L, N352Q, N352E, K353R, K353L, K353W, K353H, K353Q, K353A, K353E, E356W, E356R, N357H, F358L, E360D, G361D, G361P, V362I, D363P, D363H, I364M, I364L, I364W, I364E, I364P, K365S, K365R, K365T, K365H, K365N, K365E, K365D, F366H, F366L, F366R, F366Y, Y368R, Y368L, Q369E, Q369D, Q369R, Y370H, Y372P, D373R, D373L, D373N, D373A, D373E, S374C, S374Q, S374T, S374A, Y375W, Y375A, F376R, F376H, F376Q, F376E, F376K, D377S, D377R, D377H, D377N, D377A, R379C, E380D, E380N, E380R, E380L, K382R, K382L, K382N, K382Q, K382E, K382D, M383L, K384S, K384L, K384R, K384T, K384Q, K384E, K384D, N385P, N385T, D386H, R388E, E389D, E389R, K392F, K392M, K392R, K392L, K392Y, K392H, K392E, K393F, K393L, K393R, K393Y, K393T, K393W, K393H, K393Q, K393A, K393E, K396F, K396M, K396L, K396R, K396Q, K396A, K396E, K396I, R397S, R397L, R397H, R397Q, R397E, R397K, R397I, E400Q, E400R, E400Y, E400L, S403F, S403R, S403L, S403Y, S403T, S403W, S403H, S403A, S403E, N407F, N407R, N407L, N407Y, N407W, N407H, N407Q, N407E, N407D, N407I, L408R, L408T, L408G, L408W, L408N, or L408D; or combinations thereof.

In other embodiments, the polypeptide comprises one or more of modifications at the amino acid residue corresponding to position C17, S18, E41, T43, P44, H45, Q46, Y53, D84, H85, L89, Q92, H119, D121, C122, S123, M124, T166, D167, V168, P169, I170, A171, G172, G173, G174, E175, E176, E177, G178, V210, M212, F217, E245, H247, S248, T249, D250, K269, V270, G271, P272, Y319, L335, D336, R337, R339, or Y340 of SEQ ID NO: 6; or combinations thereof.

In some embodiments, the polypeptide comprises one or more of modifications: C17A, C17T, S18A, S18N, E41A, E41Q, H45F, H45A, H45K, H45Q, Q46R, Q46S, Q46A, Q46W, Q46T, Y53F, Y53A, Y53S, Y53V, D84G, D84A, D84N, D84P, H85A, L89G, L89S, Q92M, Q92D, Q92P, Q92G, Q92A, H119N, H119S, H119P, H119G, H119A, D121A, D121N, C122G, C122K, C122E, S123A, S123M, S123R, S123T, M124K, M124R, T166L, T166M, T166I, D167N, D167V, D167A, D167Q, D167T, V168M, V168R, I170M, I170K, I170T, A171P, G173S, E175K, E175V, E175R, E176F, E176Y, G178P, V210P, V210T, M212L, M212K, M212R, E245A, E245Q, H247A, T249S, D250A, D250N, G271D, G271A, R339G, R339A, R339E, R339T, Y340F, Y340H, Y340R, Y340P, or Y340A; or combinations thereof.

In other embodiments, the polypeptide comprises one or more of modifications at the amino acid residue corresponding to position V13, Y14, S15, I16, S19, S21, Y22, S27, F30, K34, G35, D36, Y37, S54, K62, N63, M66, K67, K72, E75, E76, D77, K78, D93, S96, P97, T98, N101, D105, F110, S113, Y115, L126, S127, D128, D129, K131, Y135, E136, E140, T142, R143, E144, F146, E147, I148, E151, T152, R154, P160, V179, V182, D184, S187, A188, I189, S190, S191, L192, Y195, N197, D198, V199, P200, N201, I202, D204, G208, I211, L213, I215, S218, Y219, V230, G232, I233, L234, V237, E240, D241, L242, V244, G246, A253, Y255, A256, N259, E262, R266, A273, R280, G281, V282, L284, S286, N287, D290, E291, I292, E295, R296, E297, K302, R303, K321, K324, R325, E327, L328, I330, W331, N333, L334, E343, Y344, E345, M349, V350, N352, K353, F358, E360, V362, D363, I364, K365, F366, Y372, D373, S374, F376, D377, R379, M383, N385, K393, R397, or S403 of SEQ ID NO:6; or combinations thereof.

In some embodiments, the polypeptide comprises one or more of modifications: V13I, Y14F, S15A, I16V, S19N, S21P, S21E, S21K, Y22W, S27A, S27C, F30H, K34D, K34M, K34R, K34Y, G35D, G35N, D36T, D36S, Y37P, S54T, K62R, N63R, M66F, M66Y, K67Q, K72V, K72L, E75P, E76P, D77N, K78P, D93H, S96E, S96A, P97D, P97E, T98E, T98Q, N101E, N101A, N101K, D105E, F110Y, S113A, Y115F, L126C, S127A, D128G, D129E, K131A, Y135P, Y135Q, Y135K, Y135N, Y135T, Y135M, Y135D, Y135L, E136D, E140I, T142E, R143V, R143A, E144R, F146C, E147R, E147K, I148V, E151R, T152A, R154Q, P160E, P160A, V179I, V182P, V182A, V182K, D184E, S187K, S187N, S187T, S187E, S187R, A188F, A188M, A188T, I189L, S190D, S190E, S191I, S191T, S191V, S191Y, S191A, S191L, L192F, L192H, Y195A, N197Q, N197K, N197E, N197D, N197A, D198K, V199I, V199H, V199L, V199C, P200G, N201R, N201Q, N201K, I202M, I202A, D204N, G208A, I211V, L213M, I215V, S218G, Y219D, Y219H, V230A, G232D, G232E, G232K, G232P, I233L, L234M, L234A, V237L, E240T, D241P, D241G, L242W, V244L, G246V, G246A, G246C, A253P, A253N, A253T, A253D, A253S, Y255D, Y255E, Y255Q, Y255K, A256L, N259R, N259E, N259W, N259D, N259A, E262Q, R266V, R266A, A273W, R280E, G281A, V282I, L284K, S286V, S286D, S286A, N287D, D290N, D290A, D290Q, D290K, E291D, I292L, E295P, R296D, R296E, R296Y, E297Q, E297K, E297G, E297H, E297R, K302L, R303E, K321T, K321N, K321R, K324D, K324E, R325D, R325N, R325E, R325Q, E327R, L328F, L328W, I330L, W331H, N333A, N333S, L334W, E343N, Y344H, E345P, M349K, M349C, M349T, M349E, M349R, M349A, V350A, N352E, K353F, F358L, E360D, V362I, D363P, I364W, K365T, K365R, F366L, Y372P, D373A, S374T, S374Q, S374A, S374C, F376Q, F376K, F376E, F376H, F376R, D377A, R379C, M383L, N385P, K393H, R397K, S403H, S403Y, or S403A; or combinations thereof.

In other embodiments, the polypeptide comprises one or more of modifications at the amino acid residue corresponding to position K5, K10, K11, C17, K32, K34, K62, K67, K70, K72, K78, K102, K104, K116, K117, C122, K131, K137, K155, K193, K194, K221, K229, K238, K269, K302, K318, K321, K324, K348, K353, K365, K382, K384, K392, K393, or K396 of SEQ ID NO:6; or combinations thereof.

In some embodiments, the polypeptide comprises one or more of modifications: K5H, K5M, K5L, K5A, K5R, K5W, K5F, K10M, K10L, K10R, K10A, K10V, K10N, K11Q, K11Y, K11E, K11L, K11R, K11V, C17T, C17I, C17L, C17A, C17R, C17V, C17G, C17S, K32Q, K32I, K32M, K32L, K32R, K32S, K34T, K34Q, K34Y, K34E, K34H, K34M, K34L, K34R, K34F, K62R, K62Y, K62V, K67R, K67T, K67Q, K67S, K70R, K70Q, K72T, K72I, K72L, K72R, K72V, K78R, K78Q, K78M, K78L, K102R, K102Y, K102L, K104Q, K104I, K104R, K104V, K104N, K104F, K116T, K116Q, K116Y, K116H, K116I, K116L, K116R, K116W, K116S, K117M, K117L, K117R, K117V, K117W, C122R, C122T, C122A, C122V, K131Q, K131Y, K131L, K131R, K137T, K137Q, K137E, K137I, K137L, K137R, K155Y, K155E, K155H, K155R, K155D, K155N, K193Q, K193E, K193I, K193R, K193A, K194T, K194E, K194R, K194A, K194S, K221Q, K221T, K221I, K221R, K221V, K229T, K229Q, K229R, K229A, K229N, K229S, K238R, K238W, K238S, K269I, K269L, K269R, K269V, K269N, K302Q, K302I, K302M, K302L, K302R, K318R, K318D, K318E, K321R, K321D, K324R, K324D, K324E, K324S, K348V, K348R, K348L, K353W, K353R, K353Q, K353L, K365R, K365H, K365S, K382R, K382N, K382L, K384T, K384Q, K384E, K384L, K384D, K384R, K384S, K392R, K392M, K392L, K393Y, K393H, K393L, K393R, K393F, K396I, K396M, K396L, K396R, or K396F; or combinations thereof.

In other embodiments, the polypeptide comprises one or more of modifications at the amino acid residue corresponding to position L3, S4, K5, D6, Y7, L8, R9, K10, K11, S21, Y22, E25, E29, F30, K32, E33, K34, G35, D36, Y37, Q49, F50, M56, E59, K62, N63, F64, M66, K67, K70, E71, K72, E75, E76, D77, K78, I80, E94, S96, T98, N101, K102, K104, D105, R108, K116, P125, D129, P130, K131, V132, P134, Y135, E136, K137, E140, R141, E144, E147, I148, E150, E151, T152, A153, R154, K155, Y156, N157, F158, Q159, P160, V161, V179, S187, S190, S191, K193, K194, Y195, N197, P200, N201, W203, D204, R205, G216, S218, Y219, D220, K221, V222, E224, D228, K229, R231, G232, E235, K238, R239, E240, D241, R258, E262, N287, D290, E291, I292, E297, S299, N300, K302, R303, E307, D313, Y315, K318, K321, D322, S323, K324, R325, L326, E327, L328, W331, E343, E345, K348, M349, N352, K353, E356, N357, G361, D363, I364, K365, F366, Y368, Q369, Y370, D373, Y375, F376, D377, E380, K382, K384, N385, D386, R388, E389, K392, K393, K396, R397, E400, S403, N407, or L408 of SEQ ID NO:6; or combinations thereof.

In some embodiments, the polypeptide comprises one or more of modifications: L3E, L3T, S4L, S4D, S4R, S4N, S4P, S4E, S4Q, S4M, K5L, K5V, K5A, K5H, K5R, K5F, K5Q, D6L, D6A, D6H, D6R, D6N, D6E, D6Q, Y7W, Y7N, Y7H, L8N, L8G, R9L, R9I, R9H, R9E, R9Q, R9T, K10D, K10A, K10R, K10N, K10P, K10E, K11I, K11V, K11H, K11Y, K11R, K11F, K11W, K11E, K11Q, S21R, S21E, S21Q, S21P, Y22W, E25R, E25I, E29L, E29R, E29Q, E29I, F30A, F30H, F30T, K32L, K32I, K32A, K32R, K32Q, K32M, E33D, E33H, E33R, E33N, E33Q, E33T, K34L, K34D, K34I, K34S, K34V, K34H, K34Y, K34R, K34F, K34Q, K34T, K34M, G35D, G35N, G35H, G35S, D36L, D36S, D36H, D36Y, D36R, D36E, D36N, D36F, D36W, D36Q, D36T, Y37E, Y37R, Y37D, Y37P, Q49W, Q49I, Q49H, Q49F, F50R, F50Q, F50H, F50S, M56W, E59R, E59S, E59T, K62R, K62A, N63R, N63E, N63D, N63Q, F64L, F64E, M66E, M66F, M66Y, K67D, K67S, K67R, K67E, K67Q, K67T, K70L, K70R, K70D, K70Q, E71R, E71Q, E71S, K72L, K72I, K72H, K72E, K72Q, K72T, E75R, E75D, E75S, E76L, E76R, E76P, D77R, D77N, D77S, K78L, K78R, K78D, K78Q, K78M, I80L, I80R, I80Q, E94L, E94R, E94Q, E94Y, S96R, S96S, S96A, T98I, T98V, T98R, T98W, T98E, T98Q, N101D, N101S, N101A, N101H, N101R, N101E, N101Q, N101T, K102Y, K102R, K102W, K102E, K102Q, K104Y, K104E, K104Q, D105E, D105Q, D105I, R108I, K116L, K116I, K116H, K116Y, K116R, K116E, K116W, K116S, K116Q, K116T, P125A, D129L, D129R, D129W, D129E, D129Q, P130S, K131D, K131E, K131S, K131Y, V132S, V132Y, V132R, V132E, V132T, P134A, P134D, P134H, Y135L, Y135D, Y135R, Y135W, Y135Q, E136S, E136R, E136P, E136W, E136D, E136Q, E136T, K137L, K137I, K137V, K137R, K137W, K137E, K137Q, E140L, E140R, E140D, E140I, R141L, R141D, R141H, R141Y, R141W, R141Q, E144R, E144Q, E144D, E144I, E147R, E147Q, E147A, I148D, I148E, I148V, E150R, E150A, E151R, T152V, T152A, T152H, T152Y, T152R, T152Q, A153R, A153Q, A153G, A153S, R154S, R154P, R154E, R154Q, R154T, K155G, K155E, K155P, K155W, K155D, K155Q, K155T, Y156V, Y156R, Y156E, Y156F, Y156D, Y156Q, Y156T, Y156M, N157E, N157D, N157R, N157P, F158L, F158V, F158R, F158N, F158E, F158T, Q159L, Q159G, Q159R, Q159W, Q159E, Q159T, P160L, P160I, P160S, P160A, P160R, P160F, P160E, P160T, P160M, V161W, V161E, V161I, V161Y, V179R, V179I, S187R, S187Q, S187A, S190D, S190E, S190Y, S191L, S191A, S191H, S191Y, S191R, S191W, S191E, S191Q, S191T, K193L, K193I, K193Y, K193R, K193F, K193E, K193Q, K194L, K194D, K194A, K194R, K194E, K194Q, Y195A, Y195Q, Y195H, N197L, N197D, N197S, N197R, N197P, N197E, N197Q, P200L, P200D, P200R, P200E, P200M, N201R, N201E, W203L, W203A, W203H, W203Y, W203R, W203F, D204R, D204N, D204S, R205L, R205Q, G216R, G216N, G216T, S218T, Y219R, Y219G, D220E, D220R, D220Q, D220T, K221I, K221V, K221R, K221E, K221Q, K221T, V222I, E224Q, E224Y, E224M, D228E, D228S, K229A, K229R, K229N, K229E, K229Q, R231L, R231A, R231E, R231F, G232R, G232E, G232P, E235R, E235W, K238S, K238R, K238W, K238E, K238Q, R239S, E240V, E240H, E240Y, E240N, E240D, E240T, E240M, D241R, D241N, D241Q, D241P, R258L, R258E, E262L, E262R, E262Q, N287L, N287H, N287R, N287F, N287E, N287Q, D290R, D290E, D290Q, D290F, E291R, I292E, I292Q, E297L, E297R, E297H, S299A, S299Q, N300E, N300D, N300R, N300Q, K302L, K302I, K302R, K302P, K302E, K302Q, K302M, R303D, R303E, R303Q, E307R, E307Q, D313P, Y315W, K318D, K318N, K321E, K321D, K321R, K321S, D322T, S323D, S323G, K324D, K324H, K324P, K324W, K324E, R325D, R325S, R325A, R325G, R325W, R325E, R325Q, L326H, E327R, E327I, E327Y, L328D, L328Y, L328R, L328W, L328E, W331L, W331E, W331F, E343L, E343Y, E343N, E343D, E343Q, E343M, E345D, E345P, K348L, K348A, K348Y, K348R, K348W, K348E, K348Q, M349I, M349Y, M349R, M349N, M349W, M349E, M349Q, M349T, N352L, N352R, N352E, N352Q, N352M, K353L, K353A, K353H, K353R, K353E, K353Q, E356R, E356W, N357H, G361D, G361P, D363H, D363P, I364L, I364E, I364P, I364M, K365D, K365S, K365R, K365N, K365E, F366L, F366R, F366H, F366Y, Y368L, Y368R, Q369L, Q369R, Q369E, Q369D, Y370H, D373L, D373R, D373E, D373N, Y375W, Y375A, F376R, F376E, F376Q, D377S, D377A, D377H, D377R, D377N, E380L, E380R, E380D, E380N, K382L, K382D, K382R, K382N, K382E, K382Q, K384L, K384S, K384R, K384E, K384D, K384Q, K384T, N385P, N385T, D386H, R388E, E389R, E389D, K392L, K392H, K392Y, K392R, K392F, K392E, K393A, K393H, K393Y, K393R, K393W, K393E, K393Q, K393T, K396I, K396A, K396R, K396E, K396Q, K396M, R397L, R397I, R397S, R397H, R397E, R397Q, E400L, E400R, E400Q, E400Y, S403L, S403A, S403Y, S403R, S403F, S403W, S403E, S403T, N407L, N407D, N407I, N407H, N407Y, N407R, N407F, N407W, N407E, N407Q, L408G, L408R, L408N, L408W, L408D, or L408T; or combinations thereof.

In one aspect, the disclosure provides polynucleotides encoding any of the polypeptides disclosed herein. The present disclosure also provides constructs, vectors, plasmids that comprises the polynucleotides.

In another aspect, the disclosure provides a microorganism expressing any of the polypeptides disclosed herein. In some embodiments, the disclosure provides a microorganism expressing a polypeptide comprising an amino acid sequence that is at least 60%, at least 65%, at least 70%, at least 75%, at least 80%, at least 85%, at least 90%, at least 95%, at least 98%, or at least 99% identical to an amino acid sequence selected from the group consisting of SEQ ID NOs: 1-444. In some embodiments, the microorganism is modified. In some embodiments, wherein the modified microorganism is genetically modified. In some embodiments, the modified microorganism is non-naturally occurring.

In some embodiments, the modified microorganism is derived from *Escherichia coli*, (hereinafter referred to as *E. coli*), *Corynebacterum glutamicum*, *Aspergillus oryzae*, *Pichia pastoris*, *Bacillus subtilis*, *Caldithrix abyssi*, *Anaerolinea thermophila*, *Thermoanaerobacterium thermosaccharolyticum*, *Thermoanaerobacter thermohydrosulfuricus*, *Caldicellulosiruptor kronotskyensis*, *Dictyoglomus turgidum*, *Caldilinea aerophila*, *Rhodothermus marinus*, *Methanohalobium evestigatum*, *Clostridium cavendishii*, *Kosmotoga olearia*, *Butyricicoccus pullicaecorum*, *Clostridium thermobutyricum*, *Litorilinea aerophila*, *Enterobacter mori.*, *Caldisericum exile*, *Dictyoglomus thermophilum*, *Rhodothermus profundi*, *Caldibacillus debilis.*, *Caloramator quimbayensis*, *Methanosalsum zhilinae*, *Pseudothermotoga thermarum*, *Pseudothermotoga hypogea*, *Pseudothermotoga lettingae*, *Geosporobacter subterraneus*, *Melioribacter roseus*, *Lysinibacillus sphaericus*, *Clostridium stercorarium*, *Truepera radiovictrix*, *Thermoflexus hugenholtzii*, *Petrotoga mobilis*, *Spirochaeta thermophila*, *Thermofilum pendens*, *Thermoanaerobacter siderophilus*, *Thermoanaerobacter mathranii*, *Thermoanaerobacter italicus*, *Thermoanaerobacterium xylanolyticum*, *Thermoanaerobacterium saccharolyticum*, *Ignisphaera aggregans*, *Thermotoga maritima*, *Caldanaerobacter subterraneus*, *Mesotoga infera*, *Thermosinus carboxydivorans*, *Halanaerobium congolense*, *Halanaerobium saccharolyticum*, *Gracilibacillus halophilus*, *Caldicoprobacter faecalis*, *Thermoanaerobacter uzonensis*, *Lactobacillus ingluviei*, *Petrotoga mexicana*, *Defluviitoga tunisiensis*, *Petrotoga miotherma*, *Petrotoga olearia*, *Thermophagus xiamenensis*, *Treponema caldarium*, *Thermofilum uzonense*.

In some embodiments, the polypeptides disclosed herein or microorganism expressing the polypeptide is immobilized. In some embodiments, the polypeptide or the microorganism expressing the polypeptide is immobilized to a carrier or support. In some embodiments, the carrier or support is an organic composition. In some embodiments, the carrier or support is an inorganic composition.

In another aspect, the disclosure provides a method of producing tagatose, the method comprising: (a) contacting fructose with any of the polypeptide disclosed herein or a microorganism expressing the polypeptide; and (b) converting fructose to tagatose. In some embodiments, the method comprises: (a) contacting fructose with a polypeptide or a microorganism expressing the polypeptide, wherein the polypeptide comprises an amino acid sequence that is at least 60%, 65%, 70%, 75%, 80%, 85%, 90%, 95%, or 98% identical to an amino acid sequence selected from the group consisting of SEQ ID NOs: 1-444; and (b) converting fructose to tagatose. In some embodiments, step (b) converts fructose to tagatose through C4-epimerization of fructose. In some embodiments, the polypeptide comprises an amino acid sequence selected from the group consisting of SEQ ID NOs: 1-444. In some embodiments, the polypeptide consists essentially of an amino acid sequence selected from the group consisting of SEQ ID NOs: 1-444. In some embodiments, the polypeptide consists of an amino acid sequence selected from the group consisting of SEQ ID NOs: 1-444. In some embodiments, the polypeptide is capable of converting fructose to tagatose through C4-epimerization of fructose. In some embodiments, the polypeptide has D-fructose C4-epimerase activity.

A method for producing a tagatose composition, comprising the steps of: (a) providing a starting composition comprising greater than about 0.3%, about 0.5%, about 1%, about 2%, about 3%, about 4%, about 5%, about 10%, about 20%, about 30%, about 40%, about 50%, about 60%, about 70%, about 80%, about 90% of fructose by weight; (b) contacting the starting composition with any of the polypeptide disclosed herein or a microorganism expressing the polypeptide; and (c) producing a tagatose composition comprising tagatose. In some embodiments, the polypeptide is capable of converting fructose to tagatose through epimerization at the carbon-4 position of fructose.

In one aspect, the disclosure provides a method for producing a tagatose composition, comprising the steps of: (a) providing a starting composition comprising greater than about 0.3%, about 0.5%, about 1%, about 2%, about 3%, about 4%, about 5%, about 10%, about 20%, about 30%, about 40%, about 50%, about 60%, about 70%, about 80%, about 90% of fructose by weight; (b) contacting the starting composition with any of the polypeptide disclosed herein or a microorganism expressing the polypeptide; and (c) producing a tagatose composition comprising tagatose. In some embodiments, the polypeptide is capable of converting fructose to tagatose through epimerization at the carbon-4 position of fructose.

In some embodiments, the tagatose composition comprises tagatose in an amount greater than about 0.1%, about 0.2%, about 0.3%, about 0.5%, about 1%, about 5%, about 10%, about 15%, about 20%, about 25%, about 30%, about 35%, or about 40% by weight. In some embodiments, contacting fructose with the polypeptide or the microorganism expressing the polypeptide is performed at a temperature between about 40° C. and about 100° C. In some embodiments, the contacting of fructose with the polypeptide or the microorganism expressing the polypeptide is performed at between about pH 4.5 and about pH 8. In some embodiments, the contacting of fructose with the polypeptide or the microorganism expressing the polypeptide is performed in the presence of a metal ion.

In some embodiments, the tagatose product is separated from the feed stock (fructose, glucose, and/or sucrose, etc.) through chromatographic means. In some embodiments, the isolated tagatose is further purified with crystallization.

DESCRIPTION OF THE DRAWINGS

The invention can be more completely understood with reference to the following drawings.

FIG. 17 depicts a sequence alignment of the native thermophilic FC4Es (SEQ ID NOs: 1-23 and SEQ ID NOs: 321-373). The residues are numbered based on the pA06238 sequence (SEQ ID NO: 6). Black squares at the top of the alignment show residue positions that were mutated in Example 12 (Active Site Mutant), Example 13 (Stability Expression Mutant), and Example 14 (Lys/Cys Only Mutant and Lys/Cys Mutant)

FIG. 18 depicts the fold change in fructose to tagatose conversion for members of the FC4E active site mutant library (reaction time 1 hour).

FIG. 23 depicts the sequence alignment of all lysine/cysteine mutants from Example 14 that allowed surrounding residues to mutate (SEQ ID NOs 232-320). Only residue positions that were mutated in at least one mutant FC4E are shown. Amino acids that were not mutated are shown as a ".".

DETAILED DESCRIPTION

I. Definitions

Figure 1:
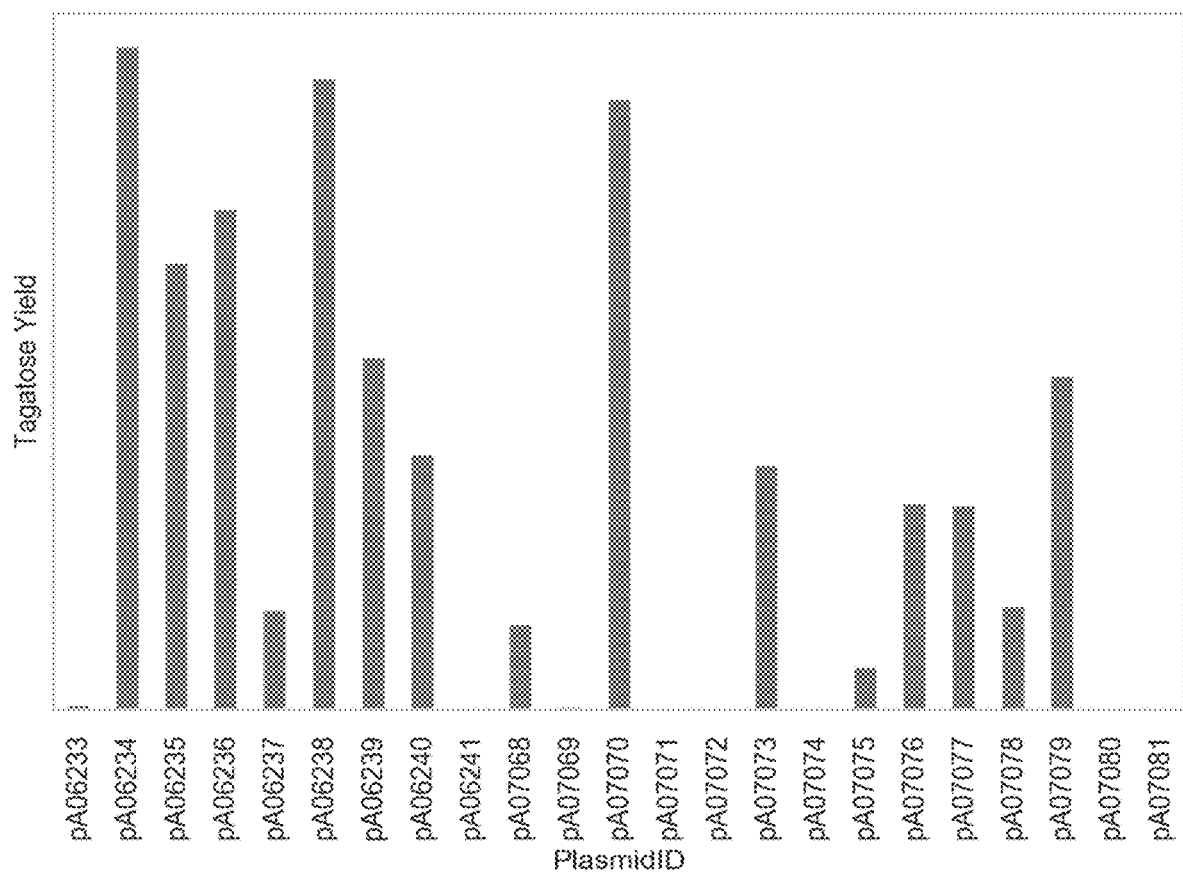
FIG. 1 depicts the measured fructose to tagatose yield for twenty-three thermophilic D-fructose C4-epimerases (Scaffold1). The FC4Es were reacted with 20 mM fructose at 60° C. overnight.

Hereinafter, the present invention will be described in more detail based on specific embodiments and examples. However, the scope the of the disclosure is not limited to these embodiments and examples. Descriptions of details apparent to those skilled in the art having ordinary knowledge in this technical field or relevant field will be omitted herein.

As used herein, the term CN refers to a carbon position defined in accordance with IUPAC nomenclature, wherein N is an integer of 1 or more. Specifically, "epimerization at the carbon 4 position" is expressed as "C4-epimerization."

As used herein, fructose refers to the monosaccharide D-fructose and tagatose refers to the monosaccharide D-tagatose.

The term "percent identity," as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "identity" and "similarity" can be readily calculated by known methods, including but not limited to those described in: Computational Molecular Biology (Lesk, A. M., ed.) Oxford University Press, New York (1988); Biocomputing: Informatics and Genome Projects (Smith, D. W., ed.) Academic Press, New York (1993); Computer Analysis of Sequence Data, Part I (Griffin, A. M., and Griffin, H. G., eds.) Humana Press, New Jersey (1994); Sequence Analysis in Molecular Biology (von Heinje, G., ed.) Academic Press (1987); and Sequence Analysis Primer (Gribskov, M. and Devereux, J., eds.) Stockton Press, New York (1991). Preferred methods to determine identity are designed to give the best match between the sequences tested. Methods to determine identity and similarity are codified in publicly available computer programs. Sequence alignments and percent identity calculations may be performed using sequence analysis software such as the Megalign program of the LASERGENE bioinformatics computing suite (DNASTAR Inc., Madison, Wis.). Multiple alignment of the sequences may be performed using the Clustal method of alignment (Higgins et al., CABIOS. 5:151 (1989)) with the default parameters (GAP PENALTY=10, GAP LENGTH PENALTY=10). Default parameters for pairwise alignments using the Clustal method may be selected: KTUPLE 1, GAP PENALTY=3, WINDOW=5 and DIAGONALS SAVED=5.

The term "modification" of an amino acid residue refers to substitution of a different amino acid residue for an original amino acid residue, deletion of an original amino acid residue, or addition of an extra amino acid residue. The "modification" preferably refers to substitution of a different amino acid residue for an original amino acid residue. Specifically, in the present invention, "modification of the charge of an amino acid residue" preferably refers to amino acid substitutions.

II. Polypeptides

In one aspect, the disclosure provides a polypeptide comprising an amino acid sequence having at least 60% sequence identity to any one of SEQ ID NOs:1-444, wherein the polypeptide has D-fructose C4-epimerase activity. In further embodiments, the polypeptide comprises an amino acid sequence that is at least 60%, at least 65%, at least 70%, at least 75%, at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, at least 99.5%, or at least 99.9% identical to any one of SEQ ID NOs: 1-444, wherein the polypeptide has D-fructose C4-epimerase activity. In some embodiments, the polypeptide comprises an amino acid sequence selected from the group consisting of SEQ ID NOs: 1-444. In some embodiments, the polypeptide is capable of converting fructose to tagatose through epimerization at carbon-4 position of fructose.

In some embodiments, the polypeptide consists essentially of an amino acid sequence that is at least 65% identical to any one of SEQ ID NOs: 1-444, wherein the polypeptide has D-fructose C4-epimerase activity. In some embodiments, the polypeptide consists essentially of an amino acid sequence that is at least 70% identical to any one of SEQ ID NOs: 1-444, wherein the polypeptide has D-fructose C4-epimerase activity. In some embodiments, the polypeptide consists essentially of an amino acid sequence that is at least 75% identical to any one of SEQ ID NOs: 1-444, wherein the polypeptide has D-fructose C4-epimerase activity. In some embodiments, the polypeptide consists essentially of an amino acid sequence that is at least 80% identical to any one of SEQ ID NOs: 1-444, wherein the polypeptide has D-fructose C4-epimerase activity. In some embodiments, the polypeptide consists essentially of an amino acid sequence that is at least 85% identical to any one of SEQ ID NOs: 1-444, wherein the polypeptide has D-fructose C4-epimerase activity. In some embodiments, the polypeptide consists essentially of an amino acid sequence that is at least 90% identical to any one of SEQ ID NOs: 1-444, wherein the polypeptide has D-fructose C4-epimerase activity. In some embodiments, the polypeptide consists essentially of an amino acid sequence that is at least 95% identical to any one of SEQ ID NOs: 1-444, wherein the polypeptide has D-fructose C4-epimerase activity. In some embodiments, the polypeptide consists essentially of an amino acid sequence that is at least 98% identical to any one of SEQ ID NOs: 1-444, wherein the polypeptide has D-fructose C4-epimerase activity. In some embodiments, the polypeptide consists essentially of an amino acid sequence that is at least 99% identical to any one of SEQ ID NOs: 1-444, wherein the polypeptide has D-fructose C4-epimerase activity.

In other embodiments, the polypeptide comprises one or more modifications at the amino acid residue corresponding to position L3, S4, K5, D6, Y7, L8, R9, K10, K11, V13, Y14, S15, I16, C17, S18, S19, S21, Y22, E25, S27, E29, F30, K32, E33, K34, G35, D36, Y37, E41, T43, P44, H45, Q46, Q49, F50, Y53, S54, M56, E59, K62, N63, F64, M66, K67, K70, E71, K72, E75, E76, D77, K78, I80, D84, H85, L89, Q92, D93, E94, S96, P97, T98, N101, K102, K104, D105, R108, F110, S113, Y115, K116, K117, H119, D121, C122, S123, M124, P125, L126, S127, D128, D129, P130, K131, V132, P134, Y135, E136, K137, E140, R141, T142, R143, E144, F146, E147, I148, E150, E151, T152, A153, R154, K155, Y156, N157, F158, Q159, P160, V161, T166, D167, V168, P169, I170, A171, G172, G173, G174, E175, E176, E177, G178, V179, V182, D184, S187, A188, I189, S190, S191, L192, K193, K194, Y195, N197, D198, V199, P200, N201, I202, W203, D204, R205, G208, V210, I211, M212, L213, I215, G216, F217, S218, Y219, D220, K221, V222, E224, D228, K229, V230, R231, G232, I233, L234, E235, V237, K238, R239, E240, D241, L242, V244, E245, G246, H247, S248, T249, D250, A253, Y255, A256, R258, N259, E262, R266, K269, V270, G271, P272, A273, R280, G281, V282, L284, S286, N287, D290, E291, I292, E295, R296, E297, S299, N300, K302, R303, E307, D313, Y315, K318, Y319, K321, D322, S323, K324, R325, L326, E327, L328, I330, W331, N333, L334, L335, D336, R337, R339, Y340, E343, Y344, E345, K348, M349, V350, N352, K353, E356, N357, F358, E360, G361, V362, D363, I364, K365, F366, Y368, Q369, Y370, Y372, D373, S374, Y375, F376, D377, R379, E380, K382, M383, K384, N385, D386, R388, E389, K392, K393, K396, R397, E400, S403, N407, or L408 of SEQ ID NO:6; or combinations thereof.

In further embodiments, the polypeptide comprises one or more of modifications: (1) the amino acid residue corresponding to position L3 of SEQ ID NO:6 is GLU, or THR; (2) the amino acid residue corresponding to position S4 of SEQ ID NO:6 is ARG, ASN, ASP, GLN, GLU, LEU, MET, or PRO; (3) the amino acid residue corresponding to position K5 of SEQ ID NO:6 is ALA, ARG, GLN, HIS, LEU, MET, PHE, TRP, or VAL; (4) the amino acid residue corresponding to position D6 of SEQ ID NO:6 is ALA, ARG, ASN, GLN, GLU, HIS, or LEU; (5) the amino acid residue corresponding to position Y7 of SEQ ID NO:6 is ASN, HIS, or TRP; (6) the amino acid residue corresponding to position L8 of SEQ ID NO:6 is ASN, or GLY; (7) the amino acid residue corresponding to position R9 of SEQ ID NO:6 is GLN, GLU, HIS, ILE, LEU, or THR; (8) the amino acid residue corresponding to position K10 of SEQ ID NO:6 is ALA, ARG, ASN, ASP, GLU, LEU, MET, PRO, or VAL; (9) the amino acid residue corresponding to position K11 of SEQ ID NO:6 is ARG, GLN, GLU, HIS, ILE, LEU, PHE, TRP, TYR, or VAL; (10) the amino acid residue corresponding to position V13 of SEQ ID NO:6 is ILE; (11) the amino acid residue corresponding to position Y14 of SEQ ID NO:6 is PHE; (12) the amino acid residue corresponding to position S15 of SEQ ID NO:6 is ALA; (13) the amino acid residue corresponding to position I16 of SEQ ID NO:6 is VAL; (14) the amino acid residue corresponding to position C17 of SEQ ID NO:6 is ALA, ARG, GLY, ILE, LEU, SER, THR, or VAL; (15) the amino acid residue corresponding to position S18 of SEQ ID NO:6 is ALA, or ASN; (16) the amino acid residue corresponding to position S19 of SEQ ID NO:6 is ASN; (17) the amino acid residue corresponding to position S21 of SEQ ID NO:6 is ARG, GLN, GLU, LYS, or PRO; (18) the amino acid residue corresponding to position Y22 of SEQ ID NO:6 is TRP; (19) the amino acid residue corresponding to position E25 of SEQ ID NO:6 is ARG, or ILE; (20) the amino acid residue corresponding to position S27 of SEQ ID NO:6 is ALA, or CYS; (21) the amino acid residue corresponding to position E29 of SEQ ID NO:6 is ARG, GLN, ILE, or LEU; (22) the amino acid residue corresponding to position F30 of SEQ ID NO:6 is ALA, HIS, or THR; (23) the amino acid residue corresponding to position K32 of SEQ ID NO:6 is ALA, ARG, GLN, ILE, LEU, MET, or SER; (24) the amino acid residue corresponding to position E33 of SEQ ID NO:6 is ARG, ASN, ASP, GLN, HIS, or THR; (25) the amino acid residue corresponding to position K34 of SEQ ID NO:6 is ARG, ASP, GLN, GLU, HIS, ILE, LEU, MET, PHE, SER, THR, TYR, or VAL; (26) the amino acid residue corresponding to position G35 of SEQ ID NO:6 is ASN, ASP, HIS, or SER; (27) the amino acid residue corresponding to position D36 of SEQ ID NO:6 is ARG, ASN, GLN, GLU, HIS, LEU, PHE, SER, THR, TRP, or TYR; (28) the amino acid residue corresponding to position Y37 of SEQ ID NO:6 is ARG, ASP, GLU, or PRO; (29) the amino acid residue corresponding to position E41 of SEQ ID NO:6 is ALA, or GLN; (30) the amino acid residue corresponding to position H45 of SEQ ID NO:6 is ALA, GLN, LYS, or PHE; (31) the amino acid residue corresponding to position Q46 of SEQ ID NO:6 is ALA, ARG, SER, THR, or TRP; (32) the amino acid residue corresponding to position Q49 of SEQ ID NO:6 is HIS, ILE, PHE, or TRP; (33) the amino acid residue corresponding to position F50 of SEQ ID NO:6 is ARG, GLN, HIS, or SER; (34) the amino acid residue corresponding to position Y53 of SEQ ID NO:6 is ALA, PHE, SER, or VAL; (35) the amino acid residue corresponding to position S54 of SEQ ID NO:6 is THR; (36) the amino acid residue corresponding to position M56 of SEQ ID NO:6 is TRP; (37) the amino acid residue corresponding to position E59 of SEQ ID NO:6 is ARG, SER, or THR; (38) the amino acid residue corresponding to position K62 of SEQ ID NO:6 is ALA, ARG, TYR, or VAL; (39) the amino acid residue corresponding to position N63 of SEQ ID NO:6 is ARG, ASP, GLN, or GLU; (40) the amino acid residue corresponding to position F64 of SEQ ID NO:6 is GLU, or LEU; (41) the amino acid residue corresponding to position M66 of SEQ ID NO:6 is GLU, PHE, or TYR; (42) the amino acid residue corresponding to position K67 of SEQ ID NO:6 is ARG, ASP, GLN, GLU, SER, or THR; (43) the amino acid residue corresponding to position K70 of SEQ ID NO:6 is ARG, ASP, GLN, or LEU; (44) the amino acid residue corresponding to position E71 of SEQ ID NO:6 is ARG, GLN, or SER; (45) the amino acid residue corresponding to position K72 of SEQ ID NO:6 is ARG, GLN, GLU, HIS, ILE, LEU, THR, or VAL; (46) the amino acid residue corresponding to position E75 of SEQ ID NO:6 is ARG, ASP, PRO, or SER; (47) the amino acid residue corresponding to position E76 of SEQ ID NO:6 is ARG, LEU, or PRO; (48) the amino acid residue corresponding to position D77 of SEQ ID NO:6 is ARG, ASN, or SER; (49) the amino acid residue corresponding to position K78 of SEQ ID NO:6 is ARG, ASP, GLN, LEU, or MET; (50) the amino acid residue corresponding to position I80 of SEQ ID NO:6 is ARG, GLN, or LEU; (51) the amino acid residue corresponding to position D84 of SEQ ID NO:6 is ALA, ASN, GLY, or PRO; (52) the amino acid residue corresponding to position H85 of SEQ ID NO:6 is ALA; (53) the amino acid residue corresponding to position L89 of SEQ ID NO:6 is GLY, or SER; (54) the amino acid residue corresponding to position Q92 of SEQ ID NO:6 is ALA, ASP, GLY, MET, or PRO; (55) the amino acid residue corresponding to position D93 of SEQ ID NO:6 is HIS; (56) the amino acid residue corresponding to position E94 of SEQ ID NO:6 is ARG, GLN, LEU, or TYR; (57) the amino acid residue corresponding to position S96 of SEQ ID NO:6 is ALA, ARG, or GLU; (58) the amino acid residue corresponding to position P97 of SEQ ID NO:6 is ASP, or GLU; (59) the amino acid residue corresponding to position T98 of SEQ ID NO:6 is ARG, GLN, GLU, ILE, TRP, or VAL; (60) the amino acid residue corresponding to position N101 of SEQ ID NO:6 is ALA, ARG, ASP, GLN, GLU, HIS, LYS, SER, or THR; (61) the amino acid residue corresponding to position K102 of SEQ ID NO:6 is ARG, GLN, GLU, LEU, TRP, or TYR; (62) the amino acid residue corresponding to position K104 of SEQ ID NO:6 is ARG, ASN, GLN, GLU, ILE, PHE, or VAL; (63) the amino acid residue corresponding to position D105 of SEQ ID NO:6 is GLN, GLU, or ILE; (64) the amino acid residue corresponding to position R108 of SEQ ID NO:6 is ILE; (65) the amino acid residue corresponding to position F110 of SEQ ID NO:6 is TYR; (66) the amino acid residue corresponding to position S113 of SEQ ID NO:6 is ALA; (67) the amino acid residue corresponding to position Y115 of SEQ ID NO:6 is PHE; (68) the amino acid residue corresponding to position K116 of SEQ ID NO:6 is ARG, ASP, GLN, GLU, HIS, ILE, LEU, SER, THR, TRP, or TYR; (69) the amino acid residue corresponding to position K117 of SEQ ID NO:6 is ARG, LEU, MET, TRP, or VAL; (70) the amino acid residue corresponding to position H119 of SEQ ID NO:6 is ALA, ASN, GLY, PRO, or SER; (71) the amino acid residue corresponding to position D121 of SEQ ID NO:6 is ALA, or ASN; (72) the amino acid residue corresponding to position C122 of SEQ ID NO:6 is ALA, ARG, GLU, GLY, LYS, THR, or VAL; (73) the amino acid residue corresponding to position S123 of SEQ ID NO:6 is ALA, ARG, MET, or THR; (74) the amino acid residue corresponding to position M124 of SEQ ID NO:6 is ARG, or LYS; (75) the amino acid residue corresponding to position P125 of SEQ ID NO:6 is ALA; (76) the amino acid residue corresponding to position L126 of SEQ ID NO:6 is CYS; (77) the amino acid residue corresponding to position S127 of SEQ ID NO:6 is ALA; (78) the amino acid residue corresponding to position D128 of SEQ ID NO:6 is GLY; (79) the amino acid residue corresponding to position D129 of SEQ ID NO:6 is ARG, GLN, GLU, LEU, or TRP; (80) the amino acid residue corresponding to position P130 of SEQ ID NO:6 is SER; (81) the amino acid residue corresponding to position K131 of SEQ ID NO:6 is ALA, ARG, ASP, GLN, GLU, LEU, SER, or TYR; (82) the amino acid residue corresponding to position V132 of SEQ ID NO:6 is ARG, GLU, SER, THR, or TYR; (83) the amino acid residue corresponding to position P134 of SEQ ID NO:6 is ALA, ASP, or HIS; (84) the amino acid residue corresponding to position Y135 of SEQ ID NO:6 is ARG, ASN, ASP, GLN, LEU, LYS, MET, PRO, THR, or TRP; (85) the amino acid residue corresponding to position E136 of SEQ ID NO:6 is ARG, ASP, GLN, PRO, SER, THR, or TRP; (86) the amino acid residue corresponding to position K137 of SEQ ID NO:6 is ARG, GLN, GLU, ILE, LEU, THR, TRP, or VAL; (87) the amino acid residue corresponding to position E140 of SEQ ID NO:6 is ARG, ASP, ILE, or LEU; (88) the amino acid residue corresponding to position R141 of SEQ ID NO:6 is ASP, GLN, HIS, LEU, TRP, or TYR; (89) the amino acid residue corresponding to position T142 of SEQ ID NO:6 is GLU; (90) the amino acid residue corresponding to position R143 of SEQ ID NO:6 is ALA, or VAL; (91) the amino acid residue corresponding to position E144 of SEQ ID NO:6 is ARG, ASP, GLN, or ILE; (92) the amino acid residue corresponding to position F146 of SEQ ID NO:6 is CYS; (93) the amino acid residue corresponding to position E147 of SEQ ID NO:6 is ALA, ARG, GLN, or LYS; (94) the amino acid residue corresponding to position I148 of SEQ ID NO:6 is ASP, GLU, or VAL; (95) the amino acid residue corresponding to position E150 of SEQ ID NO:6 is ALA, or ARG; (96) the amino acid residue corresponding to position E151 of SEQ ID NO:6 is ARG; (97) the amino acid residue corresponding to position T152 of SEQ ID NO:6 is ALA, ARG, GLN, HIS, TYR, or VAL; (98) the amino acid residue corresponding to position A153 of SEQ ID NO:6 is ARG, GLN, GLY, or SER; (99) the amino acid residue corresponding to position R154 of SEQ ID NO:6 is GLN, GLU, PRO, SER, or THR; (100) the amino acid residue corresponding to position K155 of SEQ ID NO:6 is ARG, ASN, ASP, GLN, GLU, GLY, HIS, PRO, THR, TRP, or TYR; (101) the amino acid residue corresponding to position Y156 of SEQ ID NO:6 is ARG, ASP, GLN, GLU, MET, PHE, THR, or VAL; (102) the amino acid residue corresponding to position N157 of SEQ ID NO:6 is ARG, ASP, GLU, or PRO; (103) the amino acid residue corresponding to position F158 of SEQ ID NO:6 is ARG, ASN, GLU, LEU, THR, or VAL; (104) the amino acid residue corresponding to position Q159 of SEQ ID NO:6 is ARG, GLU, GLY, LEU, THR, or TRP; (105) the amino acid residue corresponding to position P160 of SEQ ID NO:6 is ALA, ARG, GLU, ILE, LEU, MET, PHE, SER, or THR; (106) the amino acid residue corresponding to position V161 of SEQ ID NO:6 is GLU, ILE, TRP, or TYR; (107) the amino acid residue corresponding to position T166 of SEQ ID NO:6 is ILE, LEU, or MET; (108) the amino acid residue corresponding to position D167 of SEQ ID NO:6 is ALA, ASN, GLN, THR, or VAL; (109) the amino acid residue corresponding to position V168 of SEQ ID NO:6 is ARG, or MET; (110) the amino acid residue corresponding to position I170 of SEQ ID NO:6 is LYS, MET, or THR; (111) the amino acid residue corresponding to position A171 of SEQ ID NO:6 is PRO; (112) the amino acid residue corresponding to position G173 of SEQ ID NO:6 is SER; (113) the amino acid residue corresponding to position E175 of SEQ ID NO:6 is ARG, LYS, or VAL; (114) the amino acid residue corresponding to position E176 of SEQ ID NO:6 is PHE, or TYR; (115) the amino acid residue corresponding to position G178 of SEQ ID NO:6 is PRO; (116) the amino acid residue corresponding to position V179 of SEQ ID NO:6 is ARG, or ILE; (117) the amino acid residue corresponding to position V182 of SEQ ID NO:6 is ALA, LYS, or PRO; (118) the amino acid residue corresponding to position D184 of SEQ ID NO:6 is GLU; (119) the amino acid residue corresponding to position S187 of SEQ ID NO:6 is ALA, ARG, ASN, GLN, GLU, LYS, or THR; (120) the amino acid residue corresponding to position A188 of SEQ ID NO:6 is MET, PHE, or THR; (121) the amino acid residue corresponding to position I189 of SEQ ID NO:6 is LEU; (122) the amino acid residue corresponding to position S190 of SEQ ID NO:6 is ASP, GLU, or TYR; (123) the amino acid residue corresponding to position S191 of SEQ ID NO:6 is ALA, ARG, GLN, GLU, HIS, ILE, LEU, THR, TRP, TYR, or VAL; (124) the amino acid residue corresponding to position L192 of SEQ ID NO:6 is HIS, or PHE; (125) the amino acid residue corresponding to position K193 of SEQ ID NO:6 is ALA, ARG, GLN, GLU, ILE, LEU, PHE, or TYR; (126) the amino acid residue corresponding to position K194 of SEQ ID NO:6 is ALA, ARG, ASP, GLN, GLU, LEU, SER, or THR; (127) the amino acid residue corresponding to position Y195 of SEQ ID NO:6 is ALA, GLN, or HIS; (128) the amino acid residue corresponding to position N197 of SEQ ID NO:6 is ALA, ARG, ASP, GLN, GLU, LEU, LYS, PRO, or SER; (129) the amino acid residue corresponding to position D198 of SEQ ID NO:6 is LYS; (130) the amino acid residue corresponding to position V199 of SEQ ID NO:6 is CYS, HIS, ILE, or LEU; (131) the amino acid residue corresponding to position P200 of SEQ ID NO:6 is ARG, ASP, GLU, GLY, LEU, or MET; (132) the amino acid residue corresponding to position N201 of SEQ ID NO:6 is ARG, GLN, GLU, or LYS; (133) the amino acid residue corresponding to position I202 of SEQ ID NO:6 is ALA, or MET; (134) the amino acid residue corresponding to position W203 of SEQ ID NO:6 is ALA, ARG, HIS, LEU, PHE, or TYR; (135) the amino acid residue corresponding to position D204 of SEQ ID NO:6 is ARG, ASN, or SER; (136) the amino acid residue corresponding to position R205 of SEQ ID NO:6 is GLN, or LEU; (137) the amino acid residue corresponding to position G208 of SEQ ID NO:6 is ALA; (138) the amino acid residue corresponding to position V210 of SEQ ID NO:6 is PRO, or THR; (139) the amino acid residue corresponding to position I211 of SEQ ID NO:6 is VAL; (140) the amino acid residue corresponding to position M212 of SEQ ID NO:6 is ARG, LEU, or LYS;

(141) the amino acid residue corresponding to position L213 of SEQ ID NO:6 is MET; (142) the amino acid residue corresponding to position I215 of SEQ ID NO:6 is VAL; (143) the amino acid residue corresponding to position G216 of SEQ ID NO:6 is ARG, ASN, or THR; (144) the amino acid residue corresponding to position S218 of SEQ ID NO:6 is GLY, or THR; (145) the amino acid residue corresponding to position Y219 of SEQ ID NO:6 is ARG, ASP, GLY, or HIS; (146) the amino acid residue corresponding to position D220 of SEQ ID NO:6 is ARG, GLN, GLU, or THR; (147) the amino acid residue corresponding to position K221 of SEQ ID NO:6 is ARG, GLN, GLU, ILE, THR, or VAL; (148) the amino acid residue corresponding to position V222 of SEQ ID NO:6 is ILE; (149) the amino acid residue corresponding to position E224 of SEQ ID NO:6 is GLN, MET, or TYR; (150) the amino acid residue corresponding to position D228 of SEQ ID NO:6 is GLU, or SER; (151) the amino acid residue corresponding to position K229 of SEQ ID NO:6 is ALA, ARG, ASN, GLN, GLU, SER, or THR; (152) the amino acid residue corresponding to position V230 of SEQ ID NO:6 is ALA; (153) the amino acid residue corresponding to position R231 of SEQ ID NO:6 is ALA, GLU, LEU, or PHE; (154) the amino acid residue corresponding to position G232 of SEQ ID NO:6 is ARG, ASP, GLU, LYS, or PRO; (155) the amino acid residue corresponding to position I233 of SEQ ID NO:6 is LEU; (156) the amino acid residue corresponding to position L234 of SEQ ID NO:6 is ALA, or MET; (157) the amino acid residue corresponding to position E235 of SEQ ID NO:6 is ARG, or TRP; (158) the amino acid residue corresponding to position V237 of SEQ ID NO:6 is LEU; (159) the amino acid residue corresponding to position K238 of SEQ ID NO:6 is ARG, GLN, GLU, SER, or TRP; (160) the amino acid residue corresponding to position R239 of SEQ ID NO:6 is SER; (161) the amino acid residue corresponding to position E240 of SEQ ID NO:6 is ASN, ASP, HIS, MET, THR, TYR, or VAL; (162) the amino acid residue corresponding to position D241 of SEQ ID NO:6 is ARG, ASN, GLN, GLY, or PRO; (163) the amino acid residue corresponding to position L242 of SEQ ID NO:6 is TRP; (164) the amino acid residue corresponding to position V244 of SEQ ID NO:6 is LEU; (165) the amino acid residue corresponding to position E245 of SEQ ID NO:6 is ALA, or GLN; (166) the amino acid residue corresponding to position G246 of SEQ ID NO:6 is ALA, CYS, or VAL; (167) the amino acid residue corresponding to position H247 of SEQ ID NO:6 is ALA; (168) the amino acid residue corresponding to position T249 of SEQ ID NO:6 is SER; (169) the amino acid residue corresponding to position D250 of SEQ ID NO:6 is ALA, or ASN; (170) the amino acid residue corresponding to position A253 of SEQ ID NO:6 is ASN, ASP, PRO, SER, or THR; (171) the amino acid residue corresponding to position Y255 of SEQ ID NO:6 is ASP, GLN, GLU, or LYS; (172) the amino acid residue corresponding to position A256 of SEQ ID NO:6 is LEU; (173) the amino acid residue corresponding to position R258 of SEQ ID NO:6 is GLU, or LEU; (174) the amino acid residue corresponding to position N259 of SEQ ID NO:6 is ALA, ARG, ASP, GLU, or TRP; (175) the amino acid residue corresponding to position E262 of SEQ ID NO:6 is ARG, GLN, or LEU; (176) the amino acid residue corresponding to position R266 of SEQ ID NO:6 is ALA, or VAL; (177) the amino acid residue corresponding to position K269 of SEQ ID NO:6 is ARG, ASN, ILE, LEU, or VAL; (178) the amino acid residue corresponding to position G271 of SEQ ID NO:6 is ALA, or ASP; (179) the amino acid residue corresponding to position A273 of SEQ ID NO:6 is TRP; (180) the amino acid residue corresponding to position R280 of SEQ ID NO:6 is GLU; (181) the amino acid residue corresponding to position G281 of SEQ ID NO:6 is ALA; (182) the amino acid residue corresponding to position V282 of SEQ ID NO:6 is ILE; (183) the amino acid residue corresponding to position L284 of SEQ ID NO:6 is LYS; (184) the amino acid residue corresponding to position S286 of SEQ ID NO:6 is ALA, ASP, or VAL; (185) the amino acid residue corresponding to position N287 of SEQ ID NO:6 is ARG, ASP, GLN, GLU, HIS, LEU, or PHE; (186) the amino acid residue corresponding to position D290 of SEQ ID NO:6 is ALA, ARG, ASN, GLN, GLU, LYS, or PHE; (187) the amino acid residue corresponding to position E291 of SEQ ID NO:6 is ARG, or ASP; (188) the amino acid residue corresponding to position I292 of SEQ ID NO:6 is GLN, GLU, or LEU; (189) the amino acid residue corresponding to position E295 of SEQ ID NO:6 is PRO; (190) the amino acid residue corresponding to position R296 of SEQ ID NO:6 is ASP, GLU, or TYR; (191) the amino acid residue corresponding to position E297 of SEQ ID NO:6 is ARG, GLN, GLY, HIS, LEU, or LYS; (192) the amino acid residue corresponding to position S299 of SEQ ID NO:6 is ALA, or GLN; (193) the amino acid residue corresponding to position N300 of SEQ ID NO:6 is ARG, ASP, GLN, or GLU; (194) the amino acid residue corresponding to position K302 of SEQ ID NO:6 is ARG, GLN, GLU, ILE, LEU, MET, or PRO; (195) the amino acid residue corresponding to position R303 of SEQ ID NO:6 is ASP, GLN, or GLU; (196) the amino acid residue corresponding to position E307 of SEQ ID NO:6 is ARG, or GLN; (197) the amino acid residue corresponding to position D313 of SEQ ID NO:6 is PRO; (198) the amino acid residue corresponding to position Y315 of SEQ ID NO:6 is TRP; (199) the amino acid residue corresponding to position K318 of SEQ ID NO:6 is ARG, ASN, ASP, or GLU; (200) the amino acid residue corresponding to position K321 of SEQ ID NO:6 is ARG, ASP, GLU, HIS, SER, or THR; (201) the amino acid residue corresponding to position D322 of SEQ ID NO:6 is THR; (202) the amino acid residue corresponding to position S323 of SEQ ID NO:6 is ASP, or GLY; (203) the amino acid residue corresponding to position K324 of SEQ ID NO:6 is ARG, ASP, GLU, HIS, PRO, SER, or TRP; (204) the amino acid residue corresponding to position R325 of SEQ ID NO:6 is ALA, ASN, ASP, GLN, GLU, GLY, SER, or TRP; (205) the amino acid residue corresponding to position L326 of SEQ ID NO:6 is HIS; (206) the amino acid residue corresponding to position E327 of SEQ ID NO:6 is ARG, ILE, or TYR; (207) the amino acid residue corresponding to position L328 of SEQ ID NO:6 is ARG, ASP, GLU, PHE, TRP, or TYR; (208) the amino acid residue corresponding to position I330 of SEQ ID NO:6 is LEU; (209) the amino acid residue corresponding to position W331 of SEQ ID NO:6 is GLU, HIS, LEU, or PHE; (210) the amino acid residue corresponding to position N333 of SEQ ID NO:6 is ALA, or SER; (211) the amino acid residue corresponding to position L334 of SEQ ID NO:6 is TYR; (212) the amino acid residue corresponding to position R339 of SEQ ID NO:6 is ALA, GLU, GLY, or THR; (213) the amino acid residue corresponding to position Y340 of SEQ ID NO:6 is ALA, ARG, HIS, PHE, or PRO; (214) the amino acid residue corresponding to position E343 of SEQ ID NO:6 is ASN, ASP, GLN, LEU, MET, or TYR; (215) the amino acid residue corresponding to position Y344 of SEQ ID NO:6 is HIS; (216) the amino acid residue corresponding to position E345 of SEQ ID NO:6 is ASP, or PRO; (217) the amino acid residue corresponding to position K348 of SEQ ID NO:6 is ALA, ARG, GLN, GLU, LEU, TRP, TYR, or VAL; (218) the amino acid residue corresponding to position M349 of SEQ ID NO:6 is ALA, ARG, ASN, CYS, GLN, GLU, ILE, LYS, THR, TRP, or TYR; (219) the amino acid residue corresponding to position V350 of SEQ ID NO:6 is ALA; (220) the amino acid residue corresponding to position N352 of SEQ ID NO:6 is ARG, GLN, GLU, LEU, or MET; (221) the amino acid residue corresponding to position K353 of SEQ ID NO:6 is ALA, ARG, GLN, GLU, HIS, LEU, or TRP; (222) the amino acid residue corresponding to position E356 of SEQ ID NO:6 is ARG, or TRP; (223) the amino acid residue corresponding to position N357 of SEQ ID NO:6 is HIS; (224) the amino acid residue corresponding to position F358 of SEQ ID NO:6 is LEU; (225) the amino acid residue corresponding to position E360 of SEQ ID NO:6 is ASP; (226) the amino acid residue corresponding to position G361 of SEQ ID NO:6 is ASP, or PRO; (227) the amino acid residue corresponding to position V362 of SEQ ID NO:6 is ILE; (228) the amino acid residue corresponding to position D363 of SEQ ID NO:6 is HIS, or PRO; (229) the amino acid residue corresponding to position I364 of SEQ ID NO:6 is GLU, LEU, MET, PRO, or TRP; (230) the amino acid residue corresponding to position K365 of SEQ ID NO:6 is ARG, ASN, ASP, GLU, HIS, SER, or THR; (231) the amino acid residue corresponding to position F366 of SEQ ID NO:6 is ARG, HIS, LEU, or TYR; (232) the amino acid residue corresponding to position Y368 of SEQ ID NO:6 is ARG, or LEU; (233) the amino acid residue corresponding to position Q369 of SEQ ID NO:6 is ARG, ASP, GLU, or LEU; (234) the amino acid residue corresponding to position Y370 of SEQ ID NO:6 is HIS; (235) the amino acid residue corresponding to position Y372 of SEQ ID NO:6 is PRO; (236) the amino acid residue corresponding to position D373 of SEQ ID NO:6 is ALA, ARG, ASN, GLU, or LEU; (237) the amino acid residue corresponding to position S374 of SEQ ID NO:6 is ALA, CYS, GLN, or THR; (238) the amino acid residue corresponding to position Y375 of SEQ ID NO:6 is ALA, or TRP; (239) the amino acid residue corresponding to position F376 of SEQ ID NO:6 is ARG, GLN, GLU, HIS, or LYS; (240) the amino acid residue corresponding to position D377 of SEQ ID NO:6 is ALA, ARG, ASN, HIS, or SER; (241) the amino acid residue corresponding to position R379 of SEQ ID NO:6 is CYS; (242) the amino acid residue corresponding to position E380 of SEQ ID NO:6 is ARG, ASN, ASP, or LEU; (243) the amino acid residue corresponding to position K382 of SEQ ID NO:6 is ARG, ASN, ASP, GLN, GLU, or LEU; (244) the amino acid residue corresponding to position M383 of SEQ ID NO:6 is LEU; (245) the amino acid residue corresponding to position K384 of SEQ ID NO:6 is ARG, ASP, GLN, GLU, LEU, SER, or THR; (246) the amino acid residue corresponding to position N385 of SEQ ID NO:6 is PRO, or THR; (247) the amino acid residue corresponding to position D386 of SEQ ID NO:6 is HIS; (248) the amino acid residue corresponding to position R388 of SEQ ID NO:6 is GLU; (249) the amino acid residue corresponding to position E389 of SEQ ID NO:6 is ARG, or ASP; (250) the amino acid residue corresponding to position K392 of SEQ ID NO:6 is ARG, GLU, HIS, LEU, MET, PHE, or TYR; (251) the amino acid residue corresponding to position K393 of SEQ ID NO:6 is ALA, ARG, GLN, GLU, HIS, LEU, PHE, THR, TRP, or TYR; (252) the amino acid residue corresponding to position K396 of SEQ ID NO:6 is ALA, ARG, GLN, GLU, ILE, LEU, MET, or PHE; (253) the amino acid residue corresponding to position R397 of SEQ ID NO:6 is GLN, GLU, HIS, ILE, LEU, LYS, or SER; (254) the amino acid residue corresponding to position E400 of SEQ ID NO:6 is ARG, GLN, LEU, or TYR; (255) the amino acid residue corresponding to position S403 of SEQ ID NO:6 is ALA, ARG, GLU, HIS, LEU, PHE, THR, TRP, or TYR; (256) the amino acid residue corresponding to position N407 of SEQ ID NO:6 is ARG, ASP, GLN, GLU, HIS, ILE, LEU, PHE, TRP, or TYR; or (257) the amino acid residue corresponding to position L408 of SEQ ID NO:6 is ARG, ASN, ASP, GLY, THR, or TRP; or combinations thereof.

In some embodiments, the polypeptide comprises one or more of modifications: L3E, L3T, S4M, S4D, S4R, S4L, S4Q, S4N, S4E, S4P, K5F, K5M, K5L, K5R, K5W, K5H, K5Q, K5V, K5A, D6R, D6L, D6H, D6Q, D6N, D6A, D6E, Y7W, Y7H, Y7N, L8N, L8G, R9L, R9T, R9H, R9Q, R9E, R9I, K10M, K10D, K10R, K10L, K10V, K10N, K10A, K10E, K10P, K11F, K11L, K11R, K11Y, K11W, K11V, K11Q, K11H, K11E, K11I, V13I, Y14F, S15A, I16V, C17S, C17L, C17R, C17T, C17G, C17V, C17A, C17I, S18N, S18A, S19N, S21K, S21R, S21Q, S21E, S21P, Y22W, E25R, E25I, S27C, S27A, E29Q, E29R, E29I, E29L, F30H, F30T, F30A, K32S, K32M, K32L, K32R, K32Q, K32A, K32I, E33R, E33T, E33H, E33Q, E33N, E33D, K34F, K34S, K34M, K34R, K34L, K34Y, K34T, K34H, K34Q, K34V, K34E, K34D, K34I, G35D, G35N, G35H, G35S, D36F, D36S, D36R, D36L, D36Y, D36T, D36W, D36H, D36Q, D36N, D36E, Y37D, Y37P, Y37R, Y37E, E41Q, E41A, H45F, H45K, H45Q, H45A, Q46S, Q46R, Q46T, Q46W, Q46A, Q49F, Q49H, Q49I, Q49W, F50Q, F50H, F50R, F50S, Y53F, Y53V, Y53S, Y53A, S54T, M56W, E59R, E59S, E59T, K62V, K62R, K62Y, K62A, N63E, N63D, N63R, N63Q, F64E, F64L, M66F, M66E, M66Y, K67S, K67R, K67T, K67Q, K67E, K67D, K70D, K70Q, K70R, K70L, E71Q, E71R, E71S, K72L, K72R, K72T, K72V, K72Q, K72H, K72E, K72I, E75D, E75P, E75R, E75S, E76P, E76L, E76R, D77N, D77R, D77S, K78M, K78R, K78L, K78Q, K78D, I80Q, I80R, I80L, D84P, D84N, D84G, D84A, H85A, L89S, L89G, Q92M, Q92D, Q92G, Q92A, Q92P, D93H, E94Q, E94R, E94Y, E94L, S96E, S96R, S96A, P97E, P97D, T98R, T98W, T98V, T98Q, T98E, T98I, N101S, N101D, N101R, N101T, N101H, N101Q, N101A, N101E, N101K, K102L, K102R, K102Y, K102W, K102Q, K102E, K104F, K104R, K104V, K104Q, K104N, K104E, K104I, D105E, D105Q, D105I, R108I, F110Y, S113A, Y115F, K116S, K116R, K116L, K116Y, K116T, K116W, K116H, K116Q, K116E, K116D, K116I, K117M, K117L, K117R, K117W, K117V, H119S, H119G, H119N, H119A, H119P, D121N, D121A, C122R, C122G, C122T, C122V, C122A, C122E, C122K, S123M, S123R, S123T, S123A, M124K, M124R, P125A, L126C, S127A, D128G, D129N, D129L, D129W, D129Q, D129E, P130S, K131S, K131R, K131L, K131Y, K131Q, K131A, K131E, K131D, V132S, V132R, V132Y, V132T, V132E, P134D, P134H, P134A, Y135K, Y135M, Y135D, Y135L, Y135R, Y135T, Y135W, Y135Q, Y135N, Y135P, E136S, E136R, E136P, E136W, E136T, E136Q, E136D, K137L, K137R, K137T, K137W, K137V, K137Q, K137E, K137I, E140D, E140R, E140I, E140L, R141L, R141Y, R141W, R141H, R141Q, R141D, T142E, R143V, R143A, E144Q, E144D, E144R, E144I, F146C, E147Q, E147K, E147R, E147A, I148E, I148V, I148D, E150R, E150A, E151R, T152R, T152Y, T152V, T152H, T152Q, T152A, A153Q, A153R, A153G, A153S, R154S, R154T, R154Q, R154E, R154P, K155R, K155Y, K155P, K155T, K155H, K155N, K155Q, K155G, K155W, K155E, K155D, Y156F, Y156M, Y156R, Y156T, Y156V, Y156Q, Y156E, Y156D, N157E, N157D, N157R, N157P, F158R, F158L, F158T, F158V, F158N, F158E, Q159R, Q159L, Q159G, Q159T, Q159W, Q159E, P160F, P160S, P160M, P160L, P160R, P160T, P160A, P160E, P160I, V161E, V161I, V161Y, V161W, T166M, T166L, T166I, D167T, D167V, D167Q, D167N, D167A, V168M, V168R, I170M, I170K, I170T, A171P, G173S, E175K, E175V, E175R, E176F, E176Y, G178P, V179R, V179I, V182P, V182K, V182A, D184E, S187R, S187T, S187N, S187Q, S187A, S187E, S187K, A188M, A188F, A188T, I189L, S190E, S190D, S190Y, S191L, S191R, S191Y, S191T, S191W, S191V, S191H, S191Q, S191A, S191E, S191I, L192F, L192H, K193F, K193R, K193L, K193Y, K193Q, K193A, K193E, K193I, K194S, K194R, K194L, K194T, K194Q, K194A, K194E, K194D, Y195H, Y195Q, Y195A, N197S, N197D, N197R, N197L, N197P, N197Q, N197A, N197E, N197K, D198K, V199H, V199L, V199I, V199C, P200M, P200L, P200R, P200G, P200E, P200D, N201Q, N201K, N201R, N201E, I202M, I202A, W203F, W203R, W203L, W203Y, W203H, W203A, D204N, D204R, D204S, R205Q, R205L, G208A, V210P, V210T, I211V, M212K, M212L, M212R, L213M, I215V, G216N, G216R, G216T, S218T, S218G, Y219D, Y219H, Y219R, Y219G, D220Q, D220R, D220E, D220T, K221R, K221T, K221V, K221Q, K221E, K221I, V222I, E224M, E224Q, E224Y, D228E, D228S, K229S, K229R, K229T, K229N, K229Q, K229A, K229E, V230A, R231E, R231L, R231F, R231A, G232D, G232R, G232P, G232E, G232K, I233L, L234M, L234A, E235W, E235R, V237L, K238S, K238R, K238W, K238Q, K238E, R239S, E240M, E240Y, E240T, E240V, E240N, E240H, E240D, D241R, D241G, D241Q, D241N, D241P, L242W, V244L, E245Q, E245A, G246C, G246V, G246A, H247A, T249S, D250N, D250A, A253S, A253P, A253T, A253N, A253D, Y255E, Y255D, Y255Q, Y255K, A256L, R258E, R258L, N259R, N259W, N259A, N259E, N259D, E262Q, E262R, E262L, R266V, R266A, K269L, K269R, K269V, K269N, K269I, G271D, G271A, A273W, R280E, G281A, V282I, L284K, S286D, S286V, S286A, N287F, N287R, N287L, N287H, N287Q, N287E, N287D, D290F, D290R, D290Q, D290N, D290A, D290E, D290K, E291D, E291R, I292Q, I292L, I292E, E295P, R296E, R296D, R296Y, E297R, E297L, E297G, E297H, E297Q, E297K, S299Q, S299A, N300E, N300D, N300Q, N300R, K302M, K302L, K302R, K302Q, K302E, K302P, K302I, R303E, R303D, R303Q, E307Q, E307R, D313P, Y315W, K318E, K318D, K318R, K318N, K321S, K321R, K321T, K321H, K321E, K321D, D322T, S323D, S323G, K324S, K324R, K324P, K324W, K324H, K324E, K324D, R325S, R325G, R325W, R325N, R325Q, R325A, R325E, R325D, L326H, E327R, E327I, E327Y, L328F, L328R, L328Y, L328W, L328E, L328D, I330L, W331E, W331H, W331L, W331F, N333A, N333S, L334Y, R339E, R339T, R339A, R339G, Y340F, Y340R, Y340H, Y340A, Y340P, E343M, E343L, E343Y, E343Q, E343N, E343D, Y344H, E345D, E345P, K348R, K348L, K348Y, K348W, K348V, K348Q, K348A, K348E, M349R, M349Y, M349C, M349T, M349W, M349N, M349Q, M349A, M349E, M349K, M349I, V350A, N352M, N352R, N352L, N352Q, N352E, K353R, K353L, K353W, K353H, K353Q, K353A, K353E, E356W, E356R, N357H, F358L, E360D, G361D, G361P, V362I, D363P, D363H, I364M, I364L, I364W, I364E, I364P, K365S, K365R, K365T, K365H, K365N, K365E, K365D, F366H, F366L, F366R, F366Y, Y368R, Y368L, Q369E, Q369D, Q369R, Q369L, Y370H, Y372P, D373R, D373L, D373N, D373A, D373E, S374C, S374Q, S374T, S374A, Y375W, Y375A, F376R, F376H, F376Q, F376E, F376K, D377S, D377R, D377H, D377N, D377A, R379C, E380D, E380N, E380R, E380L, K382R, K382L, K382N, K382Q, K382E, K382D, M383L, K384S, K384L, K384R, K384T, K384Q, K384E, K384D, N385P, N385T, D386H, R388E, E389D, E389R, K392F, K392M, K392R, K392L, K392Y, K392H, K392E, K393F, K393L, K393R, K393Y, K393T, K393W, K393H, K393Q, K393A, K393E, K396F, K396M, K396L, K396R, K396Q, K396A, K396E, K396I, R397S, R397L, R397H, R397Q, R397E, R397K, R397I, E400Q, E400R, E400Y, E400L, S403F, S403R, S403L, S403Y, S403T, S403W, S403H, S403A, S403E, N407F, N407R, N407L, N407Y, N407W, N407H, N407Q, N407E, N407D, N407I, L408R, L408T, L408G, L408W, L408N, or L408D; or combinations thereof.

In other embodiments, the polypeptide comprises one or more of modifications at the amino acid residue corresponding to position C17, S18, E41, T43, P44, H45, Q46, Y53, D84, H85, L89, Q92, H119, D121, C122, S123, M124, T166, D167, V168, P169, I170, A171, G172, G173, G174, E175, E176, E177, G178, V210, M212, F217, E245, H247, S248, T249, D250, K269, V270, G271, P272, Y319, L335, D336, R337, R339, or Y340 of SEQ ID NO: 6; or combinations thereof.

In further embodiments, the polypeptide comprises one or more of modifications: (1) the amino acid residue corresponding to position C17 of SEQ ID NO:6 is ALA, or THR; (2) the amino acid residue corresponding to position S18 of SEQ ID NO:6 is ALA, or ASN; (3) the amino acid residue corresponding to position E41 of SEQ ID NO:6 is ALA, or GLN; (4) the amino acid residue corresponding to position H45 of SEQ ID NO:6 is ALA, GLN, LYS, or PHE; (5) the amino acid residue corresponding to position Q46 of SEQ ID NO:6 is ALA, ARG, SER, THR, or TRP; (6) the amino acid residue corresponding to position Y53 of SEQ ID NO:6 is ALA, PHE, SER, or VAL; (7) the amino acid residue corresponding to position D84 of SEQ ID NO:6 is ALA, ASN, GLY, or PRO; (8) the amino acid residue corresponding to position H85 of SEQ ID NO:6 is ALA; (9) the amino acid residue corresponding to position L89 of SEQ ID NO:6 is GLY, or SER; (10) the amino acid residue corresponding to position Q92 of SEQ ID NO:6 is ALA, ASP, GLY, MET, or PRO; (11) the amino acid residue corresponding to position H119 of SEQ ID NO:6 is ALA, ASN, GLY, PRO, or SER; (12) the amino acid residue corresponding to position D121 of SEQ ID NO:6 is ALA, or ASN; (13) the amino acid residue corresponding to position C122 of SEQ ID NO:6 is GLU, GLY, or LYS; (14) the amino acid residue corresponding to position S123 of SEQ ID NO:6 is ALA, ARG, MET, or THR; (15) the amino acid residue corresponding to position M124 of SEQ ID NO:6 is ARG, or LYS; (16) the amino acid residue corresponding to position T166 of SEQ ID NO:6 is ILE, LEU, or MET; (17) the amino acid residue corresponding to position D167 of SEQ ID NO:6 is ALA, ASN, GLN, THR, or VAL; (18) the amino acid residue corresponding to position V168 of SEQ ID NO:6 is ARG, or MET; (19) the amino acid residue corresponding to position I170 of SEQ ID NO:6 is LYS, MET, or THR; (20) the amino acid residue corresponding to position A171 of SEQ ID NO:6 is PRO; (21) the amino acid residue corresponding to position G173 of SEQ ID NO:6 is SER; (22) the amino acid residue corresponding to position E175 of SEQ ID NO:6 is ARG, LYS, or VAL; (23) the amino acid residue corresponding to position E176 of SEQ ID NO:6 is PHE, or TYR; (24) the amino acid residue corresponding to position G178 of SEQ ID NO:6 is PRO; (25) the amino acid residue corresponding to position V210 of SEQ ID NO:6 is PRO, or THR; (26) the amino acid residue corresponding to position M212 of SEQ ID NO:6 is ARG, LEU, or LYS; (27) the amino acid residue corresponding to position E245 of SEQ ID NO:6 is ALA, or GLN; (28) the amino acid residue corresponding to position H247 of SEQ ID NO:6 is ALA; (29) the amino acid residue corresponding to position T249 of SEQ ID NO:6 is SER; (30) the amino acid residue corresponding to position D250 of SEQ ID NO:6 is ALA, or ASN; (31) the amino acid residue corresponding to position G271 of SEQ ID NO:6 is ALA, or ASP; (32) the amino acid residue corresponding to position R339 of SEQ ID NO:6 is ALA, GLU, GLY, or THR; or (33) the amino acid residue corresponding to position Y340 of SEQ ID NO:6 is ALA, ARG, HIS, PHE, or PRO; or combinations thereof.

In some embodiments, the polypeptide comprises one or more of modifications: C17A, C17T, S18A, S18N, E41A, E41Q, H45F, H45A, H45K, H45Q, Q46R, Q46S, Q46A, Q46W, Q46T, Y53F, Y53A, Y53S, Y53V, D84G, D84A, D84N, D84P, H85A, L89G, L89S, Q92M, Q92D, Q92P, Q92G, Q92A, H119N, H119S, H119P, H119G, H119A, D121A, D121N, C122G, C122K, C122E, S123A, S123M, S123R, S123T, M124K, M124R, T166L, T166M, T166I, D167N, D167V, D167A, D167Q, D167T, V168M, V168R, I170M, I170K, I170T, A171P, G173S, E175K, E175V, E175R, E176F, E176Y, G178P, V210P, V210T, M212L, M212K, M212R, E245A, E245Q, H247A, T249S, D250A, D250N, G271D, G271A, R339G, R339A, R339E, R339T, Y340F, Y340H, Y340R, Y340P, or Y340A; or combinations thereof.

In other embodiments, the polypeptide comprises one or more of modifications at the amino acid residue corresponding to position V13, Y14, S15, I16, S19, S21, Y22, S27, F30, K34, G35, D36, Y37, S54, K62, N63, M66, K67, K72, E75, E76, D77, K78, D93, S96, P97, T98, N101, D105, F110, S113, Y115, L126, S127, D128, D129, K131, Y135, E136, E140, T142, R143, E144, F146, E147, I148, E151, T152, R154, P160, V179, V182, D184, S187, A188, I189, S190, S191, L192, Y195, N197, D198, V199, P200, N201, I202, D204, G208, I211, L213, I215, S218, Y219, V230, G232, I233, L234, V237, E240, D241, L242, V244, G246, A253, Y255, A256, N259, E262, R266, A273, R280, G281, V282, L284, S286, N287, D290, E291, I292, E295, R296, E297, K302, R303, K321, K324, R325, E327, L328, I330, W331, N333, L334, E343, Y344, E345, M349, V350, N352, K353, F358, E360, V362, D363, I364, K365, F366, Y372, D373, S374, F376, D377, R379, M383, N385, K393, R397, or S403 of SEQ ID NO:6; or combinations thereof.

In further embodiments, the polypeptide comprises one or more of modifications: (1) the amino acid residue corresponding to position V13 of SEQ ID NO:6 is ILE; (2) the amino acid residue corresponding to position Y14 of SEQ ID NO:6 is PHE; (3) the amino acid residue corresponding to position S15 of SEQ ID NO:6 is ALA; (4) the amino acid residue corresponding to position I16 of SEQ ID NO:6 is VAL; (5) the amino acid residue corresponding to position S19 of SEQ ID NO:6 is ASN; (6) the amino acid residue corresponding to position S21 of SEQ ID NO:6 is GLU, LYS, or PRO; (7) the amino acid residue corresponding to position Y22 of SEQ ID NO:6 is TRP; (8) the amino acid residue corresponding to position S27 of SEQ ID NO:6 is ALA, or CYS; (9) the amino acid residue corresponding to position F30 of SEQ ID NO:6 is HIS; (10) the amino acid residue corresponding to position K34 of SEQ ID NO:6 is ARG, ASP, MET, or TYR; (11) the amino acid residue corresponding to position G35 of SEQ ID NO:6 is ASP, or HIS; (12) the amino acid residue corresponding to position D36 of SEQ ID NO:6 is SER, or THR; (13) the amino acid residue corresponding to position Y37 of SEQ ID NO:6 is PRO; (14) the amino acid residue corresponding to position S54 of SEQ ID NO:6 is THR; (15) the amino acid residue corresponding to position K62 of SEQ ID NO:6 is ARG; (16) the amino acid residue corresponding to position N63 of SEQ ID NO:6 is ARG; (17) the amino acid residue corresponding to position M66 of SEQ ID NO:6 is PHE, or TYR; (18) the amino acid residue corresponding to position K67 of SEQ ID NO:6 is GLN; (19) the amino acid residue corresponding to position K72 of SEQ ID NO:6 is LEU, or VAL; (20) the amino acid residue corresponding to position E75 of SEQ ID NO:6 is PRO; (21) the amino acid residue corresponding to position E76 of SEQ ID NO:6 is PRO; (22) the amino acid residue corresponding to position D77 of SEQ ID NO:6 is ASN; (23) the amino acid residue corresponding to position K78 of SEQ ID NO:6 is ARG; (24) the amino acid residue corresponding to position D93 of SEQ ID NO:6 is HIS; (25) the amino acid residue corresponding to position S96 of SEQ ID NO:6 is ALA, or GLU; (26) the amino acid residue corresponding to position P97 of SEQ ID NO:6 is ASP, or GLU; (27) the amino acid residue corresponding to position T98 of SEQ ID NO:6 is GLN, or GLU; (28) the amino acid residue corresponding to position N101 of SEQ ID NO:6 is ALA, GLU, or LYS; (29) the amino acid residue corresponding to position D105 of SEQ ID NO:6 is GLU; (30) the amino acid residue corresponding to position F110 of SEQ ID NO:6 is TYR; (31) the amino acid residue corresponding to position S113 of SEQ ID NO:6 is ALA; (32) the amino acid residue corresponding to position Y115 of SEQ ID NO:6 is PHE; (33) the amino acid residue corresponding to position L126 of SEQ ID NO:6 is CYS; (34) the amino acid residue corresponding to position S127 of SEQ ID NO:6 is ALA; (35) the amino acid residue corresponding to position D128 of SEQ ID NO:6 is GLY; (36) the amino acid residue corresponding to position D129 of SEQ ID NO:6 is GLU; (37) the amino acid residue corresponding to position K131 of SEQ ID NO:6 is ALA; (38) the amino acid residue corresponding to position Y135 of SEQ ID NO:6 is ASN, ASP, GLN, LEU, LYS, MET, PRO, or THR; (39) the amino acid residue corresponding to position E136 of SEQ ID NO:6 is ASP; (40) the amino acid residue corresponding to position E140 of SEQ ID NO:6 is ILE; (41) the amino acid residue corresponding to position T142 of SEQ ID NO:6 is GLU; (42) the amino acid residue corresponding to position R143 of SEQ ID NO:6 is ALA, or VAL; (43) the amino acid residue corresponding to position E144 of SEQ ID NO:6 is ARG; (44) the amino acid residue corresponding to position F146 of SEQ ID NO:6 is CYS; (45) the amino acid residue corresponding to position E147 of SEQ ID NO:6 is ARG, or LYS; (46) the amino acid residue corresponding to position I148 of SEQ ID NO:6 is VAL; (47) the amino acid residue corresponding to position E151 of SEQ ID NO:6 is ARG; (48) the amino acid residue corresponding to position T152 of SEQ ID NO:6 is ALA; (49) the amino acid residue corresponding to position R154 of SEQ ID NO:6 is GLN; (50) the amino acid residue corresponding to position P160 of SEQ ID NO:6 is ALA, or GLU; (51) the amino acid residue corresponding to position V179 of SEQ ID NO:6 is ILE; (52) the amino acid residue corresponding to position V182 of SEQ ID NO:6 is ALA, LYS, or PRO; (53) the amino acid residue corresponding to position D184 of SEQ ID NO:6 is GLU; (54) the amino acid residue corresponding to position S187 of SEQ ID NO:6 is ARG, ASN, GLU, LYS, or THR; (55) the amino acid residue corresponding to position A188 of SEQ ID NO:6 is MET, PHE, or THR; (56) the amino acid residue corresponding to position I189 of SEQ ID NO:6 is LEU; (57) the amino acid residue corresponding to position S190 of SEQ ID NO:6 is ASP, or GLU; (58) the amino acid residue corresponding to position S191 of SEQ ID NO:6 is ALA, ILE, LEU, THR, TYR, or VAL; (59) the amino acid residue corresponding to position L192 of SEQ ID NO:6 is HIS, or PHE; (60) the amino acid residue corresponding to position Y195 of SEQ ID NO:6 is ALA; (61) the amino acid residue corresponding to position N197 of SEQ ID NO:6 is ALA, ASP, GLN, GLU, or LYS; (62) the amino acid residue corresponding to position D198 of SEQ ID NO:6 is LYS; (63) the amino acid residue corresponding to position V199 of SEQ ID NO:6 is CYS, HIS, ILE, or LEU; (64) the amino acid residue corresponding to position P200 of SEQ ID NO:6 is GLY; (65) the amino acid residue corresponding to position N201 of SEQ ID NO:6 is ARG, GLN, or LYS; (66) the amino acid residue corresponding to position I202 of SEQ ID NO:6 is ALA, or MET; (67) the amino acid residue corresponding to position D204 of SEQ ID NO:6 is ASN; (68) the amino acid residue corresponding to position G208 of SEQ ID NO:6 is ALA; (69) the amino acid residue corresponding to position I211 of SEQ ID NO:6 is VAL; (70) the amino acid residue corresponding to position L213 of SEQ ID NO:6 is MET; (71) the amino acid residue corresponding to position I215 of SEQ ID NO:6 is VAL; (72) the amino acid residue corresponding to position S218 of SEQ ID NO:6 is GLY; (73) the amino acid residue corresponding to position Y219 of SEQ ID NO:6 is ASP, or HIS; (74) the amino acid residue corresponding to position V230 of SEQ ID NO:6 is ALA; (75) the amino acid residue corresponding to position G232 of SEQ ID NO:6 is ASP, GLU, LYS, or PRO; (76) the amino acid residue corresponding to position I233 of SEQ ID NO:6 is LEU; (77) the amino acid residue corresponding to position L234 of SEQ ID NO:6 is ALA, or MET; (78) the amino acid residue corresponding to position V237 of SEQ ID NO:6 is LEU; (79) the amino acid residue corresponding to position E240 of SEQ ID NO:6 is THR; (80) the amino acid residue corresponding to position D241 of SEQ ID NO:6 is GLY, or PRO; (81) the amino acid residue corresponding to position L242 of SEQ ID NO:6 is TRP; (82) the amino acid residue corresponding to position V244 of SEQ ID NO:6 is LEU; (83) the amino acid residue corresponding to position G246 of SEQ ID NO:6 is ALA, CYS, or VAL; (84) the amino acid residue corresponding to position A253 of SEQ ID NO:6 is ASN, ASP, PRO, SER, or THR; (85) the amino acid residue corresponding to position Y255 of SEQ ID NO:6 is ASP, GLN, GLU, or LYS; (86) the amino acid residue corresponding to position A256 of SEQ ID NO:6 is LEU; (87) the amino acid residue corresponding to position N259 of SEQ ID NO:6 is ALA, ARG, ASP, GLU, or TRP; (88) the amino acid residue corresponding to position E262 of SEQ ID NO:6 is GLN; (89) the amino acid residue corresponding to position R266 of SEQ ID NO:6 is ALA, or VAL; (90) the amino acid residue corresponding to position A273 of SEQ ID NO:6 is TRP; (91) the amino acid residue corresponding to position R280 of SEQ ID NO:6 is GLU; (92) the amino acid residue corresponding to position G281 of SEQ ID NO:6 is ALA; (93) the amino acid residue corresponding to position V282 of SEQ ID NO:6 is ILE; (94) the amino acid residue corresponding to position L284 of SEQ ID NO:6 is LYS; (95) the amino acid residue corresponding to position S286 of SEQ ID NO:6 is ALA, ASP, or VAL; (96) the amino acid residue corresponding to position N287 of SEQ ID NO:6 is ASP; (97) the amino acid residue corresponding to position D290 of SEQ ID NO:6 is ALA, ASN, GLN, or LYS; (98) the amino acid residue corresponding to position E291 of SEQ ID NO:6 is ASP; (99) the amino acid residue corresponding to position I292 of SEQ ID NO:6 is LEU; (100) the amino acid residue corresponding to position E295 of SEQ ID NO:6 is PRO; (101) the amino acid residue corresponding to position R296 of SEQ ID NO:6 is ASP, GLU, or TYR; (102) the amino acid residue corresponding to position E297 of SEQ ID NO:6 is ARG, GLN, GLY, HIS, or LYS; (103) the amino acid residue corresponding to position K302 of SEQ ID NO:6 is LEU; (104) the amino acid residue corresponding to position R303 of SEQ ID NO:6 is GLU; (105) the amino acid residue corresponding to position K321 of SEQ ID NO:6 is ARG, HIS, or THR; (106) the amino acid residue corresponding to position K324 of SEQ ID NO:6 is ASP, or GLU; (107) the amino acid residue corresponding to position R325 of SEQ ID NO:6 is ASN, ASP, GLN, or GLU; (108) the amino acid residue corresponding to position E327 of SEQ ID NO:6 is ARG; (109) the amino acid residue corresponding to position L328 of SEQ ID NO:6 is PHE, or TRP; (110) the amino acid residue corresponding to position I330 of SEQ ID NO:6 is LEU; (111) the amino acid residue corresponding to position W331 of SEQ ID NO:6 is HIS; (112) the amino acid residue corresponding to position N333 of SEQ ID NO:6 is ALA, or SER; (113) the amino acid residue corresponding to position L334 of SEQ ID NO:6 is TYR; (114) the amino acid residue corresponding to position E343 of SEQ ID NO:6 is ASN; (115) the amino acid residue corresponding to position Y344 of SEQ ID NO:6 is HIS; (116) the amino acid residue corresponding to position E345 of SEQ ID NO:6 is PRO; (117) the amino acid residue corresponding to position M349 of SEQ ID NO:6 is ALA, ARG, CYS, GLU, LYS, or THR; (118) the amino acid residue corresponding to position V350 of SEQ ID NO:6 is ALA; (119) the amino acid residue corresponding to position N352 of SEQ ID NO:6 is GLU; (120) the amino acid residue corresponding to position K353 of SEQ ID NO:6 is ARG; (121) the amino acid residue corresponding to position F358 of SEQ ID NO:6 is LEU; (122) the amino acid residue corresponding to position E360 of SEQ ID NO:6 is ASP; (123) the amino acid residue corresponding to position V362 of SEQ ID NO:6 is ILE; (124) the amino acid residue corresponding to position D363 of SEQ ID NO:6 is PRO; (125) the amino acid residue corresponding to position I364 of SEQ ID NO:6 is TRP; (126) the amino acid residue corresponding to position K365 of SEQ ID NO:6 is ARG, or THR; (127) the amino acid residue corresponding to position F366 of SEQ ID NO:6 is LEU; (128) the amino acid residue corresponding to position Y372 of SEQ ID NO:6 is PRO; (129) the amino acid residue corresponding to position D373 of SEQ ID NO:6 is ALA; (130) the amino acid residue corresponding to position S374 of SEQ ID NO:6 is ALA, CYS, GLN, or THR; (131) the amino acid residue corresponding to position F376 of SEQ ID NO:6 is ARG, GLN, GLU, HIS, or LYS; (132) the amino acid residue corresponding to position D377 of SEQ ID NO:6 is ALA; (133) the amino acid residue corresponding to position R379 of SEQ ID NO:6 is CYS; (134) the amino acid residue corresponding to position M383 of SEQ ID NO:6 is LEU; (135) the amino acid residue corresponding to position N385 of SEQ ID NO:6 is PRO; (136) the amino acid residue corresponding to position K393 of SEQ ID NO:6 is HIS; (137) the amino acid residue corresponding to position R397 of SEQ ID NO:6 is LYS; or (138) the amino acid residue corresponding to position S403 of SEQ ID NO:6 is ALA, HIS, or TYR; or combinations thereof.

In some embodiments, the polypeptide comprises one or more of modifications: V13I, Y14F, S15A, I16V, S19N, S21P, S21E, S21K, Y22W, S27A, S27C, F30H, K34D, K34M, K34R, K34Y, G35D, G35H, D36T, D36S, Y37P, S54T, K62R, N63R, M66F, M66Y, K67Q, K72V, K72L, E75P, E76P, D77N, K78R, D93H, S96E, S96A, P97D, P97E, T98E, T98Q, N101E, N101A, N101K, D105E, F110Y, S113A, Y115F, L126C, S127A, D128G, D129E, K131A, Y135P, Y135Q, Y135K, Y135N, Y135T, Y135M, Y135D, Y135L, E136D, E140I, T142E, R143V, R143A, E144R, F146C, E147R, E147K, I148V, E151R, T152A, R154Q, P160E, P160A, V179I, V182P, V182A, V182K, D184E, S187K, S187N, S187T, S187E, S187R, A188F, A188M, A188T, I189L, S190D, S190E, S191I, S191T, S191V, S191Y, S191A, S191L, L192F, L192H, Y195A, N197Q, N197K, N197E, N197D, N197A, D198K, V199I, V199H, V199L, V199C, P200G, N201R, N201Q, N201K, I202M, I202A, D204N, G208A, I211V, L213M, I215V, S218G, Y219D, Y219H, V230A, G232D, G232E, G232K, G232P, I233L, L234M, L234A, V237L, E240T, D241P, D241G, L242W, V244L, G246V, G246A, G246C, A253P, A253N, A253T, A253D, A253S, Y255D, Y255E, Y255Q, Y255K, A256L, N259R, N259E, N259W, N259D, N259A, E262Q, R266V, R266A, A273W, R280E, G281A, V282I, L284K, S286V, S286D, S286A, N287D, D290N, D290A, D290Q, D290K, E291D, I292L, E295P, R296D, R296E, R296Y, E297Q, E297K, E297G, E297H, E297R, K302L, R303E, K321T, K321H, K321R, K324D, K324E, R325D, R325N, R325E, R325Q, E327R, L328F, L328W, I330L, W331H, N333A, N333S, L334Y, E343N, Y344H, E345P, M349K, M349C, M349T, M349E, M349R, M349A, V350A, N352E, K353R, F358L, E360D, V362I, D363P, I364W, K365T, K365R, F366L, Y372P, D373A, S374T, S374Q, S374A, S374C, F376Q, F376K, F376E, F376H, F376R, D377A, R379C, M383L, N385P, K393H, R397K, S403H, S403Y, or S403A; or combinations thereof.

In other embodiments, the polypeptide comprises one or more of modifications at the amino acid residue corresponding to position K5, K10, K11, C17, K32, K34, K62, K67, K70, K72, K78, K102, K104, K116, K117, C122, K131, K137, K155, K193, K194, K221, K229, K238, K269, K302, K318, K321, K324, K348, K353, K365, K382, K384, K392, K393, or K396 of SEQ ID NO:6; or combinations thereof.

In further embodiments, the polypeptide comprises one or more of modifications: (1) the amino acid residue corresponding to position K5 of SEQ ID NO:6 is ALA, ARG, HIS, LEU, MET, PHE, or TRP; (2) the amino acid residue corresponding to position K10 of SEQ ID NO:6 is ALA, ARG, ASN, LEU, MET, or VAL; (3) the amino acid residue corresponding to position K11 of SEQ ID NO:6 is ARG, GLN, GLU, LEU, TYR, or VAL; (4) the amino acid residue corresponding to position C17 of SEQ ID NO:6 is ALA, ARG, GLY, ILE, LEU, SER, THR, or VAL; (5) the amino acid residue corresponding to position K32 of SEQ ID NO:6 is ARG, GLN, ILE, LEU, MET, or SER; (6) the amino acid residue corresponding to position K34 of SEQ ID NO:6 is ARG, GLN, GLU, HIS, LEU, MET, PHE, THR, or TYR; (7) the amino acid residue corresponding to position K62 of SEQ ID NO:6 is ARG, TYR, or VAL; (8) the amino acid residue corresponding to position K67 of SEQ ID NO:6 is ARG, GLN, SER, or THR; (9) the amino acid residue corresponding to position K70 of SEQ ID NO:6 is ARG, or GLN; (10) the amino acid residue corresponding to position K72 of SEQ ID NO:6 is ARG, ILE, LEU, THR, or VAL; (11) the amino acid residue corresponding to position K78 of SEQ ID NO:6 is ARG, GLN, LEU, or MET; (12) the amino acid residue corresponding to position K102 of SEQ ID NO:6 is ARG, LEU, or TYR; (13) the amino acid residue corresponding to position K104 of SEQ ID NO:6 is ARG, ASN, GLN, ILE, PHE, or VAL; (14) the amino acid residue corresponding to position K116 of SEQ ID NO:6 is ARG, GLN, HIS, ILE, LEU, SER, THR, TRP, or TYR; (15) the amino acid residue corresponding to position K117 of SEQ ID NO:6 is ARG, LEU, MET, TRP, or VAL; (16) the amino acid residue corresponding to position C122 of SEQ ID NO:6 is ALA, ARG, THR, or VAL; (17) the amino acid residue corresponding to position K131 of SEQ ID NO:6 is ARG, GLN, GLU, LEU, or TYR; (18) the amino acid residue corresponding to position K137 of SEQ ID NO:6 is ARG, GLN, GLU, ILE, LEU, or THR; (19) the amino acid residue corresponding to position K155 of SEQ ID NO:6 is ARG, ASN, ASP, GLU, HIS, or TYR; (20) the amino acid residue corresponding to position K193 of SEQ ID NO:6 is ALA, ARG, GLN, GLU, or ILE; (21) the amino acid residue corresponding to position K194 of SEQ ID NO:6 is ALA, ARG, GLU, SER, or THR; (22) the amino acid residue corresponding to position K221 of SEQ ID NO:6 is ARG, GLN, ILE, THR, or VAL; (23) the amino acid residue corresponding to position K229 of SEQ ID NO:6 is ALA, ARG, ASN, GLN, SER, or THR; (24) the amino acid residue corresponding to position K238 of SEQ ID NO:6 is ARG, SER, or TRP; (25) the amino acid residue corresponding to position K269 of SEQ ID NO:6 is ARG, ASN, ILE, LEU, or VAL; (26) the amino acid residue corresponding to position K302 of SEQ ID NO:6 is ARG, GLN, ILE, LEU, or MET; (27) the amino acid residue corresponding to position K318 of SEQ ID NO:6 is ARG, ASP, or GLU; (28) the amino acid residue corresponding to position K321 of SEQ ID NO:6 is ARG, or ASP; (29) the amino acid residue corresponding to position K324 of SEQ ID NO:6 is ARG, ASP, GLU, or SER; (30) the amino acid residue corresponding to position K348 of SEQ ID NO:6 is ARG, LEU, or VAL; (31) the amino acid residue corresponding to position K353 of SEQ ID NO:6 is ARG, GLN, LEU, or TRP; (32) the amino acid residue corresponding to position K365 of SEQ ID NO:6 is ARG, HIS, or SER; (33) the amino acid residue corresponding to position K382 of SEQ ID NO:6 is ARG, ASN, or LEU; (34) the amino acid residue corresponding to position K384 of SEQ ID NO:6 is ARG, ASP, GLN, GLU, LEU, SER, or THR; (35) the amino acid residue corresponding to position K392 of SEQ ID NO:6 is ARG, LEU, or MET; (36) the amino acid residue corresponding to position K393 of SEQ ID NO:6 is ARG, HIS, LEU, PHE, or TYR; or (37) the amino acid residue corresponding to position K396 of SEQ ID NO:6 is ARG, ILE, LEU, MET, or PHE; or combinations thereof.

In some embodiments, the polypeptide comprises one or more of modifications: K5H, K5M, K5L, K5A, K5R, K5W, K5F, K10M, K10L, K10R, K10A, K10V, K10N, K11Q, K11Y, K11E, K11L, K11R, K11V, C17T, C17I, C17L, C17A, C17R, C17V, C17G, C17S, K32Q, K32I, K32M, K32L, K32R, K32S, K34T, K34Q, K34Y, K34E, K34H, K34M, K34L, K34R, K34F, K62R, K62Y, K62V, K67R, K67T, K67Q, K67S, K70R, K70Q, K72T, K72I, K72L, K72R, K72V, K78R, K78Q, K78M, K78L, K102R, K102Y, K102L, K104Q, K104I, K104R, K104V, K104N, K104F, K116T, K116Q, K116Y, K116H, K116I, K116L, K116R, K116W, K116S, K117M, K117L, K117R, K117V, K117W, C122R, C122T, C122A, C122V, K131Q, K131Y, K131E, K131L, K131R, K137T, K137Q, K137E, K137I, K137L, K137R, K155Y, K155E, K155H, K155R, K155D, K155N, K193Q, K193E, K193I, K193R, K193A, K194T, K194E, K194R, K194A, K194S, K221Q, K221T, K221I, K221R, K221V, K229T, K229Q, K229R, K229A, K229N, K229S, K238R, K238W, K238S, K269I, K269L, K269R, K269V, K269N, K302Q, K302I, K302M, K302L, K302R, K318R, K318D, K318E, K321R, K321D, K324R, K324D, K324E, K324S, K348V, K348R, K348L, K353W, K353R, K353Q, K353L, K365R, K365H, K365S, K382R, K382N, K382L, K384T, K384Q, K384E, K384L, K384D, K384R, K384S, K392R, K392M, K392L, K393Y, K393H, K393L, K393R, K393F, K396I, K396M, K396L, K396R, or K396F; or combinations thereof.

In other embodiments, the polypeptide comprises one or more of modifications at the amino acid residue corresponding to position L3, S4, K5, D6, Y7, L8, R9, K10, K11, S21, Y22, E25, E29, F30, K32, E33, K34, G35, D36, Y37, Q49, F50, M56, E59, K62, N63, F64, M66, K67, K70, E71, K72, E75, E76, D77, K78, I80, E94, S96, T98, N101, K102, K104, D105, R108, K116, P125, D129, P130, K131, V132, P134, Y135, E136, K137, E140, R141, E144, E147, I148, E150, E151, T152, A153, R154, K155, Y156, N157, F158, Q159, P160, V161, V179, S187, S190, S191, K193, K194, Y195, N197, P200, N201, W203, D204, R205, G216, S218, Y219, D220, K221, V222, E224, D228, K229, R231, G232, E235, K238, R239, E240, D241, R258, E262, N287, D290, E291, I292, E297, S299, N300, K302, R303, E307, D313, Y315, K318, K321, D322, S323, K324, R325, L326, E327, L328, W331, E343, E345, K348, M349, N352, K353, E356, N357, G361, D363, I364, K365, F366, Y368, Q369, Y370, D373, Y375, F376, D377, E380, K382, K384, N385, D386, R388, E389, K392, K393, K396, R397, E400, S403, N407, or L408 of SEQ ID NO:6; or combinations thereof.

In further embodiments, the polypeptide comprises one or more of modifications: (1) the amino acid residue corresponding to position L3 of SEQ ID NO:6 is GLU, or THR; (2) the amino acid residue corresponding to position S4 of SEQ ID NO:6 is ARG, ASN, ASP, GLN, GLU, LEU, MET, or PRO; (3) the amino acid residue corresponding to position K5 of SEQ ID NO:6 is ALA, ARG, GLN, HIS, LEU, PHE, or VAL; (4) the amino acid residue corresponding to position D6 of SEQ ID NO:6 is ALA, ARG, ASN, GLN, GLU, HIS, or LEU; (5) the amino acid residue corresponding to position Y7 of SEQ ID NO:6 is ASN, HIS, or TRP; (6) the amino acid residue corresponding to position L8 of SEQ ID NO:6 is ASN, or GLY; (7) the amino acid residue corresponding to position R9 of SEQ ID NO:6 is GLN, GLU, HIS, ILE, LEU, or THR; (8) the amino acid residue corresponding to position K10 of SEQ ID NO:6 is ALA, ARG, ASN, ASP, GLU, or PRO; (9) the amino acid residue corresponding to position K11 of SEQ ID NO:6 is ARG, GLN, GLU, HIS, ILE, PHE, TRP, TYR, or VAL; (10) the amino acid residue corresponding to position S21 of SEQ ID NO:6 is ARG, GLN, GLU, or PRO; (11) the amino acid residue corresponding to position Y22 of SEQ ID NO:6 is TRP; (12) the amino acid residue corresponding to position E25 of SEQ ID NO:6 is ARG, or ILE; (13) the amino acid residue corresponding to position E29 of SEQ ID NO:6 is ARG, GLN, ILE, or LEU; (14) the amino acid residue corresponding to position F30 of SEQ ID NO:6 is ALA, HIS, or THR; (15) the amino acid residue corresponding to position K32 of SEQ ID NO:6 is ALA, ARG, GLN, ILE, LEU, or MET; (16) the amino acid residue corresponding to position E33 of SEQ ID NO:6 is ARG, ASN, ASP, GLN, HIS, or THR; (17) the amino acid residue corresponding to position K34 of SEQ ID NO:6 is ARG, ASP, GLN, HIS, ILE, LEU, MET, PHE, SER, THR, TYR, or VAL; (18) the amino acid residue corresponding to position G35 of SEQ ID NO:6 is ASN, ASP, HIS, or SER; (19) the amino acid residue corresponding to position D36 of SEQ ID NO:6 is ARG, ASN, GLN, GLU, HIS, LEU, PHE, SER, THR, TRP, or TYR; (20) the amino acid residue corresponding to position Y37 of SEQ ID NO:6 is ARG, ASP, GLU, or PRO; (21) the amino acid residue corresponding to position Q49 of SEQ ID NO:6 is HIS, ILE, PHE, or TRP; (22) the amino acid residue corresponding to position F50 of SEQ ID NO:6 is ARG, GLN, HIS, or SER; (23) the amino acid residue corresponding to position M56 of SEQ ID NO:6 is TRP; (24) the amino acid residue corresponding to position E59 of SEQ ID NO:6 is ARG, SER, or THR; (25) the amino acid residue corresponding to position K62 of SEQ ID NO:6 is ALA, or ARG; (26) the amino acid residue corresponding to position N63 of SEQ ID NO:6 is ARG, ASP, GLN, or GLU; (27) the amino acid residue corresponding to position F64 of SEQ ID NO:6 is GLU, or LEU; (28) the amino acid residue corresponding to position M66 of SEQ ID NO:6 is GLU, PHE, or TYR; (29) the amino acid residue corresponding to position K67 of SEQ ID NO:6 is ARG, ASP, GLN, GLU, SER, or THR; (30) the amino acid residue corresponding to position K70 of SEQ ID NO:6 is ARG, ASP, GLN, or LEU; (31) the amino acid residue corresponding to position E71 of SEQ ID NO:6 is ARG, GLN, or SER; (32) the amino acid residue corresponding to position K72 of SEQ ID NO:6 is GLN, GLU, HIS, ILE, LEU, or THR; (33) the amino acid residue corresponding to position E75 of SEQ ID NO:6 is ARG, ASP, or SER; (34) the amino acid residue corresponding to position E76 of SEQ ID NO:6 is ARG, LEU, or PRO; (35) the amino acid residue corresponding to position D77 of SEQ ID NO:6 is ARG, ASN, or SER; (36) the amino acid residue corresponding to position K78 of SEQ ID NO:6 is ARG, ASP, GLN, LEU, or MET; (37) the amino acid residue corresponding to position I80 of SEQ ID NO:6 is ARG, GLN, or LEU; (38) the amino acid residue corresponding to position E94 of SEQ ID NO:6 is ARG, GLN, LEU, or TYR; (39) the amino acid residue corresponding to position S96 of SEQ ID NO:6 is ALA, ARG, or GLU; (40) the amino acid residue corresponding to position T98 of SEQ ID NO:6 is ARG, GLN, GLU, ILE, TRP, or VAL; (41) the amino acid residue corresponding to position N101 of SEQ ID NO:6 is ALA, ARG, ASP, GLN, GLU, HIS, SER, or THR; (42) the amino acid residue corresponding to position K102 of SEQ ID NO:6 is ARG, GLN, GLU, TRP, or TYR; (43) the amino acid residue corresponding to position K104 of SEQ ID NO:6 is ARG, GLN, or GLU; (44) the amino acid residue corresponding to position D105 of SEQ ID NO:6 is GLN, GLU, or ILE; (45) the amino acid residue corresponding to position R108 of SEQ ID NO:6 is ILE; (46) the amino acid residue corresponding to position K116 of SEQ ID NO:6 is ARG, ASP, GLN, GLU, HIS, ILE, LEU, THR, TRP, or TYR; (47) the amino acid residue corresponding to position P125 of SEQ ID NO:6 is ALA; (48) the amino acid residue corresponding to position D129 of SEQ ID NO:6 is ARG, GLN, GLU, LEU, or TRP; (49) the amino acid residue corresponding to position P130 of SEQ ID NO:6 is SER; (50) the amino acid residue corresponding to position K131 of SEQ ID NO:6 is ASP, GLU, SER, or TYR; (51) the amino acid residue corresponding to position V132 of SEQ ID NO:6 is ARG, GLU, SER, THR, or TYR; (52) the amino acid residue corresponding to position P134 of SEQ ID NO:6 is ALA, ASP, or HIS; (53) the amino acid residue corresponding to position Y135 of SEQ ID NO:6 is ARG, ASP, GLN, LEU, or TRP; (54) the amino acid residue corresponding to position E136 of SEQ ID NO:6 is ARG, ASP, GLN, PRO, SER, THR, or TRP; (55) the amino acid residue corresponding to position K137 of SEQ ID NO:6 is ARG, GLN, GLU, ILE, LEU, TRP, or VAL; (56) the amino acid residue corresponding to position E140 of SEQ ID NO:6 is ARG, ASP, ILE, or LEU; (57) the amino acid residue corresponding to position R141 of SEQ ID NO:6 is ASP, GLN, HIS, LEU, TRP, or TYR; (58) the amino acid residue corresponding to position E144 of SEQ ID NO:6 is ARG, ASP, GLN, or ILE; (59) the amino acid residue corresponding to position E147 of SEQ ID NO:6 is ALA, ARG, or GLN; (60) the amino acid residue corresponding to position I148 of SEQ ID NO:6 is ASP, GLU, or VAL; (61) the amino acid residue corresponding to position E150 of SEQ ID NO:6 is ALA, or ARG; (62) the amino acid residue corresponding to position E151 of SEQ ID NO:6 is ARG; (63) the amino acid residue corresponding to position T152 of SEQ ID NO:6 is ALA, ARG, GLN, HIS, TYR, or VAL;

(64) the amino acid residue corresponding to position A153 of SEQ ID NO:6 is ARG, GLN, GLY, or SER; (65) the amino acid residue corresponding to position R154 of SEQ ID NO:6 is GLN, GLU, PRO, SER, or THR; (66) the amino acid residue corresponding to position K155 of SEQ ID NO:6 is ASP, GLN, GLU, GLY, PRO, THR, or TRP; (67) the amino acid residue corresponding to position Y156 of SEQ ID NO:6 is ARG, ASP, GLN, GLU, MET, PHE, THR, or VAL; (68) the amino acid residue corresponding to position N157 of SEQ ID NO:6 is ARG, ASP, GLU, or PRO; (69) the amino acid residue corresponding to position F158 of SEQ ID NO:6 is ARG, ASN, GLU, LEU, THR, or VAL; (70) the amino acid residue corresponding to position Q159 of SEQ ID NO:6 is ARG, GLU, GLY, LEU, THR, or TRP; (71) the amino acid residue corresponding to position P160 of SEQ ID NO:6 is ALA, ARG, GLU, ILE, LEU, MET, PHE, SER, or THR; (72) the amino acid residue corresponding to position V161 of SEQ ID NO:6 is GLU, ILE, TRP, or TYR; (73) the amino acid residue corresponding to position V179 of SEQ ID NO:6 is ARG, or ILE; (74) the amino acid residue corresponding to position S187 of SEQ ID NO:6 is ALA, ARG, or GLN; (75) the amino acid residue corresponding to position S190 of SEQ ID NO:6 is ASP, GLU, or TYR; (76) the amino acid residue corresponding to position S191 of SEQ ID NO:6 is ALA, ARG, GLN, GLU, HIS, LEU, THR, TRP, or TYR; (77) the amino acid residue corresponding to position K193 of SEQ ID NO:6 is ARG, GLN, GLU, ILE, LEU, PHE, or TYR; (78) the amino acid residue corresponding to position K194 of SEQ ID NO:6 is ALA, ARG, ASP, GLN, GLU, or LEU; (79) the amino acid residue corresponding to position Y195 of SEQ ID NO:6 is ALA, GLN, or HIS; (80) the amino acid residue corresponding to position N197 of SEQ ID NO:6 is ARG, ASP, GLN, GLU, LEU, PRO, or SER; (81) the amino acid residue corresponding to position P200 of SEQ ID NO:6 is ARG, ASP, GLU, LEU, or MET; (82) the amino acid residue corresponding to position N201 of SEQ ID NO:6 is ARG, or GLU; (83) the amino acid residue corresponding to position W203 of SEQ ID NO:6 is ALA, ARG, HIS, LEU, PHE, or TYR; (84) the amino acid residue corresponding to position D204 of SEQ ID NO:6 is ARG, ASN, or SER; (85) the amino acid residue corresponding to position R205 of SEQ ID NO:6 is GLN, or LEU; (86) the amino acid residue corresponding to position G216 of SEQ ID NO:6 is ARG, ASN, or THR; (87) the amino acid residue corresponding to position S218 of SEQ ID NO:6 is THR; (88) the amino acid residue corresponding to position Y219 of SEQ ID NO:6 is ARG, or GLY; (89) the amino acid residue corresponding to position D220 of SEQ ID NO:6 is ARG, GLN, GLU, or THR; (90) the amino acid residue corresponding to position K221 of SEQ ID NO:6 is ARG, GLN, GLU, ILE, THR, or VAL; (91) the amino acid residue corresponding to position V222 of SEQ ID NO:6 is ILE; (92) the amino acid residue corresponding to position E224 of SEQ ID NO:6 is GLN, MET, or TYR; (93) the amino acid residue corresponding to position D228 of SEQ ID NO:6 is GLU, or SER; (94) the amino acid residue corresponding to position K229 of SEQ ID NO:6 is ALA, ARG, ASN, GLN, or GLU; (95) the amino acid residue corresponding to position R231 of SEQ ID NO:6 is ALA, GLU, LEU, or PHE; (96) the amino acid residue corresponding to position G232 of SEQ ID NO:6 is ARG, GLU, or PRO; (97) the amino acid residue corresponding to position E235 of SEQ ID NO:6 is ARG, or TRP; (98) the amino acid residue corresponding to position K238 of SEQ ID NO:6 is ARG, GLN, GLU, SER, or TRP; (99) the amino acid residue corresponding to position R239 of SEQ ID NO:6 is SER; (100) the amino acid residue corresponding to position E240 of SEQ ID NO:6 is ASN, ASP, HIS, MET, THR, TYR, or VAL; (101) the amino acid residue corresponding to position D241 of SEQ ID NO:6 is ARG, ASN, GLN, or PRO; (102) the amino acid residue corresponding to position R258 of SEQ ID NO:6 is GLU, or LEU; (103) the amino acid residue corresponding to position E262 of SEQ ID NO:6 is ARG, GLN, or LEU; (104) the amino acid residue corresponding to position N287 of SEQ ID NO:6 is ARG, GLN, GLU, HIS, LEU, or PHE; (105) the amino acid residue corresponding to position D290 of SEQ ID NO:6 is ARG, GLN, GLU, or PHE; (106) the amino acid residue corresponding to position E291 of SEQ ID NO:6 is ARG; (107) the amino acid residue corresponding to position I292 of SEQ ID NO:6 is GLN, or GLU; (108) the amino acid residue corresponding to position E297 of SEQ ID NO:6 is ARG, HIS, or LEU; (109) the amino acid residue corresponding to position S299 of SEQ ID NO:6 is ALA, or GLN; (110) the amino acid residue corresponding to position N300 of SEQ ID NO:6 is ARG, ASP, GLN, or GLU; (111) the amino acid residue corresponding to position K302 of SEQ ID NO:6 is ARG, GLN, GLU, ILE, LEU, MET, or PRO; (112) the amino acid residue corresponding to position R303 of SEQ ID NO:6 is ASP, GLN, or GLU; (113) the amino acid residue corresponding to position E307 of SEQ ID NO:6 is ARG, or GLN; (114) the amino acid residue corresponding to position D313 of SEQ ID NO:6 is PRO; (115) the amino acid residue corresponding to position Y315 of SEQ ID NO:6 is TRP; (116) the amino acid residue corresponding to position K318 of SEQ ID NO:6 is ASN, or ASP; (117) the amino acid residue corresponding to position K321 of SEQ ID NO:6 is ARG, ASP, GLU, or SER; (118) the amino acid residue corresponding to position D322 of SEQ ID NO:6 is THR; (119) the amino acid residue corresponding to position S323 of SEQ ID NO:6 is ASP, or GLY; (120) the amino acid residue corresponding to position K324 of SEQ ID NO:6 is ASP, GLU, HIS, PRO, or TRP; (121) the amino acid residue corresponding to position R325 of SEQ ID NO:6 is ALA, ASP, GLN, GLU, GLY, SER, or TRP; (122) the amino acid residue corresponding to position L326 of SEQ ID NO:6 is HIS; (123) the amino acid residue corresponding to position E327 of SEQ ID NO:6 is ARG, ILE, or TYR; (124) the amino acid residue corresponding to position L328 of SEQ ID NO:6 is ARG, ASP, GLU, TRP, or TYR; (125) the amino acid residue corresponding to position W331 of SEQ ID NO:6 is GLU, LEU, or PHE; (126) the amino acid residue corresponding to position E343 of SEQ ID NO:6 is ASN, ASP, GLN, LEU, MET, or TYR; (127) the amino acid residue corresponding to position E345 of SEQ ID NO:6 is ASP, or PRO; (128) the amino acid residue corresponding to position K348 of SEQ ID NO:6 is ALA, ARG, GLN, GLU, LEU, TRP, or TYR; (129) the amino acid residue corresponding to position M349 of SEQ ID NO:6 is ARG, ASN, GLN, GLU, ILE, THR, TRP, or TYR; (130) the amino acid residue corresponding to position N352 of SEQ ID NO:6 is ARG, GLN, GLU, LEU, or MET; (131) the amino acid residue corresponding to position K353 of SEQ ID NO:6 is ALA, ARG, GLN, GLU, HIS, or LEU; (132) the amino acid residue corresponding to position E356 of SEQ ID NO:6 is ARG, or TRP; (133) the amino acid residue corresponding to position N357 of SEQ ID NO:6 is HIS; (134) the amino acid residue corresponding to position G361 of SEQ ID NO:6 is ASP, or PRO; (135) the amino acid residue corresponding to position D363 of SEQ ID NO:6 is HIS, or PRO; (136) the amino acid residue corresponding to position I364 of SEQ ID NO:6 is GLU, LEU, MET, or PRO; (137) the amino acid residue corresponding to position K365 of SEQ ID NO:6 is ARG, ASN, ASP, GLU, or SER; (138) the amino acid residue corresponding to position F366 of SEQ ID NO:6 is ARG, HIS, LEU, or TYR; (139) the amino acid residue corresponding to position Y368 of SEQ ID NO:6 is ARG, or LEU; (140) the amino acid residue corresponding to position Q369 of SEQ ID NO:6 is ARG, ASP, GLU, or LEU; (141) the amino acid residue corresponding to position Y370 of SEQ ID NO:6 is HIS; (142) the amino acid residue corresponding to position D373 of SEQ ID NO:6 is ARG, ASN, GLU, or LEU; (143) the amino acid residue corresponding to position Y375 of SEQ ID NO:6 is ALA, or TRP; (144) the amino acid residue corresponding to position F376 of SEQ ID NO:6 is ARG, GLN, or GLU; (145) the amino acid residue corresponding to position D377 of SEQ ID NO:6 is ALA, ARG, ASN, HIS, or SER; (146) the amino acid residue corresponding to position E380 of SEQ ID NO:6 is ARG, ASN, ASP, or LEU; (147) the amino acid residue corresponding to position K382 of SEQ ID NO:6 is ARG, ASN, ASP, GLN, GLU, or LEU; (148) the amino acid residue corresponding to position K384 of SEQ ID NO:6 is ARG, ASP, GLN, GLU, LEU, SER, or THR; (149) the amino acid residue corresponding to position N385 of SEQ ID NO:6 is PRO, or THR; (150) the amino acid residue corresponding to position D386 of SEQ ID NO:6 is HIS; (151) the amino acid residue corresponding to position R388 of SEQ ID NO:6 is GLU; (152) the amino acid residue corresponding to position E389 of SEQ ID NO:6 is ARG, or ASP; (153) the amino acid residue corresponding to position K392 of SEQ ID NO:6 is ARG, GLU, HIS, LEU, PHE, or TYR; (154) the amino acid residue corresponding to position K393 of SEQ ID NO:6 is ALA, ARG, GLN, GLU, HIS, THR, TRP, or TYR; (155) the amino acid residue corresponding to position K396 of SEQ ID NO:6 is ALA, ARG, GLN, GLU, ILE, or MET; (156) the amino acid residue corresponding to position R397 of SEQ ID NO:6 is GLN, GLU, HIS, ILE, LEU, or SER; (157) the amino acid residue corresponding to position E400 of SEQ ID NO:6 is ARG, GLN, LEU, or TYR; (158) the amino acid residue corresponding to position S403 of SEQ ID NO:6 is ALA, ARG, GLU, LEU, PHE, THR, TRP, or TYR; (159) the amino acid residue corresponding to position N407 of SEQ ID NO:6 is ARG, ASP, GLN, GLU, HIS, ILE, LEU, PHE, TRP, or TYR; or (160) the amino acid residue corresponding to position L408 of SEQ ID NO:6 is ARG, ASN, ASP, GLY, THR, or TRP; or combinations thereof.

In some embodiments, the polypeptide comprises one or more of modifications: L3E, L3T, S4L, S4D, S4R, S4N, S4P, S4E, S4Q, S4M, K5L, K5V, K5A, K5H, K5R, K5F, K5Q, D6L, D6A, D6H, D6R, D6N, D6E, D6Q, Y7W, Y7N, Y7H, L8N, L8G, R9L, R9I, R9H, R9E, R9Q, R9T, K10D, K10A, K10R, K10N, K10P, K10E, K11I, K11V, K11H, K11Y, K11R, K11F, K11W, K11E, K11Q, S21R, S21E, S21Q, S21P, Y22W, E25R, E25I, E29L, E29R, E29Q, E29I, F30A, F30H, F30T, K32L, K32I, K32A, K32R, K32Q, K32M, E33D, E33H, E33R, E33N, E33Q, E33T, K34L, K34D, K34I, K34S, K34V, K34H, K34Y, K34R, K34F, K34Q, K34T, K34M, G35D, G35N, G35H, G35S, D36L, D36S, D36H, D36Y, D36R, D36E, D36N, D36F, D36W, D36Q, D36T, Y37E, Y37R, Y37D, Y37P, Q49W, Q49I, Q49H, Q49F, F50R, F50Q, F50H, F50S, M56W, E59R, E59S, E59T, K62R, K62A, N63R, N63E, N63D, N63Q, F64L, F64E, M66E, M66F, M66Y, K67D, K67S, K67R, K67E, K67Q, K67T, K70L, K70R, K70D, K70Q, E71R, E71Q, E71S, K72L, K72I, K72H, K72E, K72Q, K72T, E75R, E75D, E75S, E76L, E76R, E76P, D77R, D77N, D77S, K78L, K78R, K78D, K78Q, K78M, I80L, I80R, I80Q, E94L, E94R, E94Q, E94Y, S96R, S96E, S96A, T98I, T98V, T98R, T98W, T98E, T98Q, N101D, N101S, N101A, N101H, N101R, N101E, N101Q, N101T, K102Y, K102R, K102W, K102E, K102Q, K104R, K104E, K104Q, D105E, D105Q, D105I, R108I, K116L, K116I, K116H, K116Y, K116R, K116E, K116K, K116W, K116D, K116Q, K116T, P125A, D129L, D129R, D129W, D129E, D129Q, P130S, K131D, K131E, K131S, K131Y, V132S, V132Y, V132R, V132E, V132T, P134A, P134D, P134H, Y135L, Y135D, Y135R, Y135W, Y135Q, E136S, E136R, E136P, E136W, E136D, E136Q, E136T, K137L, K137I, K137V, K137R, K137W, K137E, K137Q, E140L, E140R, E140D, E140I, R141L, R141D, R141H, R141Y, R141W, R141Q, E144R, E144Q, E144D, E144I, E147R, E147Q, E147A, I148D, I148E, I148V, E150R, E150A, E151R, T152V, T152A, T152H, T152Y, T152R, T152Q, A153R, A153Q, A153G, A153S, R154S, R154P, R154E, R154Q, R154T, K155G, K155E, K155P, K155W, K155D, K155Q, K155T, Y156V, Y156R, Y156E, Y156F, Y156D, Y156Q, Y156T, Y156M, N157E, N157D, N157R, N157P, F158L, F158V, F158R, F158N, F158E, F158T, Q159L, Q159G, Q159R, Q159W, Q159E, Q159T, P160L, P160I, P160S, P160A, P160R, P160F, P160E, P160T, P160M, V161W, V161E, V161I, V161Y, V179R, V179I, S187R, S187Q, S187A, S190D, S190E, S190Y, S191L, S191A, S191H, S191Y, S191R, S191W, S191E, S191Q, S191T, K193L, K193I, K193Y, K193R, K193F, K193E, K193Q, K194L, K194D, K194A, K194R, K194E, K194Q, Y195A, Y195Q, Y195H, N197L, N197D, N197S, N197R, N197P, N197E, N197Q, P200L, P200D, P200R, P200E, P200M, N201R, N201E, W203L, W203A, W203H, W203Y, W203R, W203F, D204R, D204N, D204S, R205L, R205Q, G216R, G216N, G216T, S218T, Y219R, Y219G, D220E, D220R, D220Q, D220T, K221I, K221V, K221R, K221E, K221Q, K221T, V222I, E224Q, E224Y, E224M, D228E, D228S, K229A, K229R, K229N, K229E, K229Q, R231L, R231A, R231E, R231F, G232R, G232E, G232P, E235R, E235W, K238S, K238R, K238W, K238E, K238Q, R239S, E240V, E240H, E240Y, E240N, E240D, E240T, E240M, D241R, D241N, D241Q, D241P, R258L, R258E, E262L, E262R, E262Q, N287L, N287H, N287R, N287F, N287E, N287Q, D290R, D290E, D290Q, D290F, E291R, I292E, I292Q, E297L, E297R, E297H, S299A, S299Q, N300E, N300D, N300R, N300Q, K302L, K302I, K302R, K302P, K302E, K302Q, K302M, R303D, R303E, R303Q, E307R, E307Q, D313P, Y315W, K318D, K318N, K321E, K321D, K321R, K321S, D322T, S323D, S323Q, K324D, K324H, K324P, K324W, K324E, R325D, R325S, R325A, R325G, R325W, R325E, R325Q, L326H, E327R, E327I, E327Y, L328D, L328Y, L328R, L328W, L328E, W331L, W331E, W331F, E343L, E343Y, E343N, E343D, E343Q, E343M, E345D, E345P, K348L, K348A, K348Y, K348R, K348W, K348E, K348Q, M349I, M349Y, M349R, M349N, M349W, M349E, M349Q, M349T, N352L, N352R, N352E, N352Q, N352M, K353L, K353A, K353H, K353R, K353E, K353Q, E356R, E356W, N357H, G361D, G361P, D363H, D363P, I364L, I364E, I364P, I364M, K365D, K365S, K365R, K365N, K365E, F366L, F366R, F366H, F366Y, Y368L, Y368R, Q369L, Q369R, Q369E, Q369D, Y370H, D373L, D373R, D373E, D373N, Y375W, Y375A, F376R, F376E, F376Q, D377S, D377A, D377H, D377R, D377N, E380L, E380R, E380D, E380N, K382L, K382D, K382R, K382N, K382E, K382Q, K384L, K384S, K384R, K384E, K384D, K384Q, K384T, N385P, N385T, D386H, R388E, E389R, E389D, K392L, K392H, K392Y, K392R, K392F, K392E, K393A, K393H, K393Y, K393R, K393W, K393E, K393Q, K393T, K396I, K396A, K396R, K396E, K396Q, K396M, R397L, R397I, R397S, R397H, R397E, R397Q, E400L, E400R, E400Q, E400Y, S403L, S403A, S403Y, S403R, S403F, S403W, S403E, S403T, N407L, N407D, N407I, N407H, N407Y, N407R, N407F, N407W, N407E, N407Q, L408G, L408R, L408N, L408W, L408D, or L408T; or combinations thereof.

Figure 20:
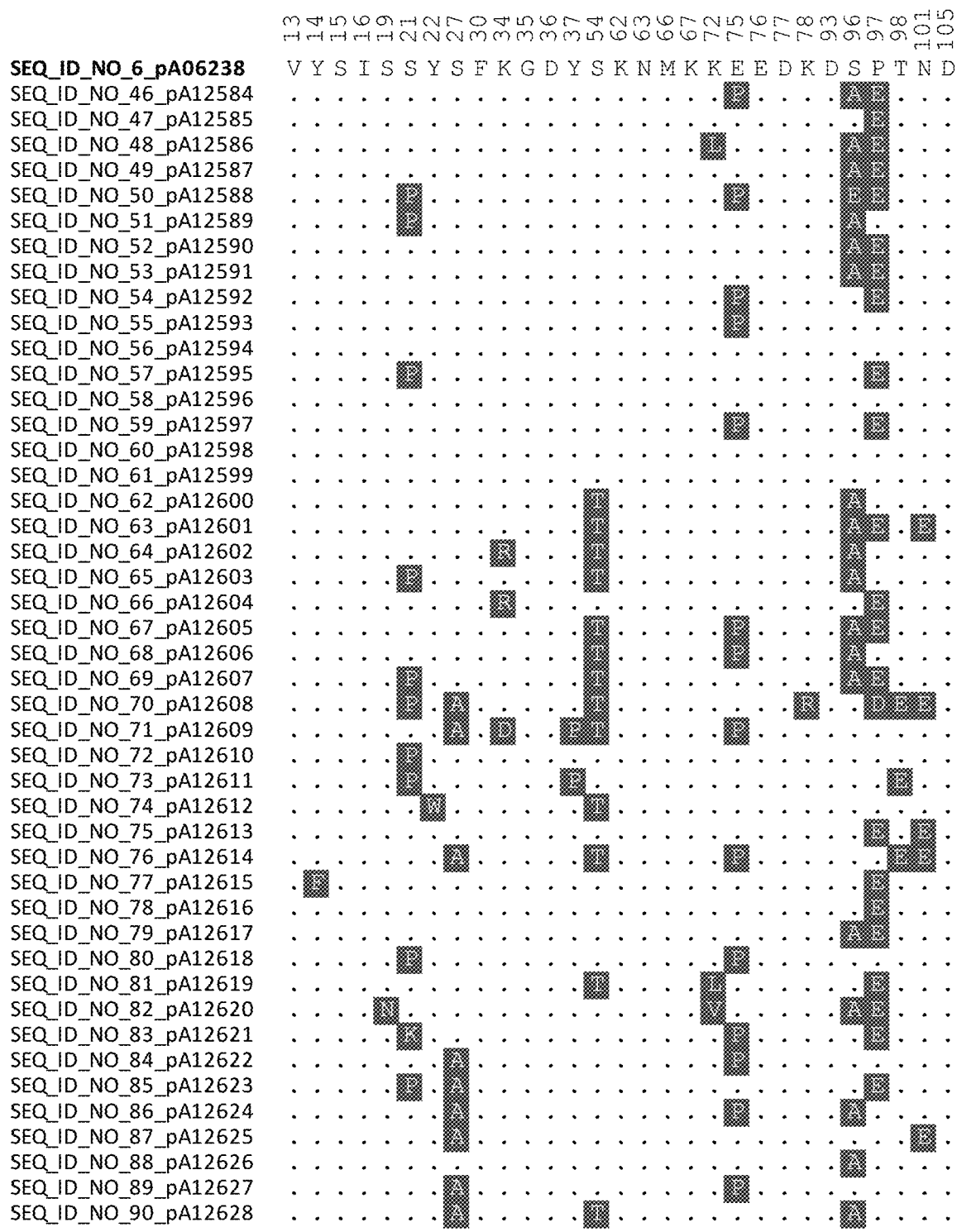
FIG. 20 depicts the sequence alignment of all computationally designed stability/expression mutants from Example 13 (SEQ ID NOs 46-136). Only residue positions that were mutated in at least one mutant FC4E are shown. Amino acids that were not mutated are shown as a ".".
Figure 20:
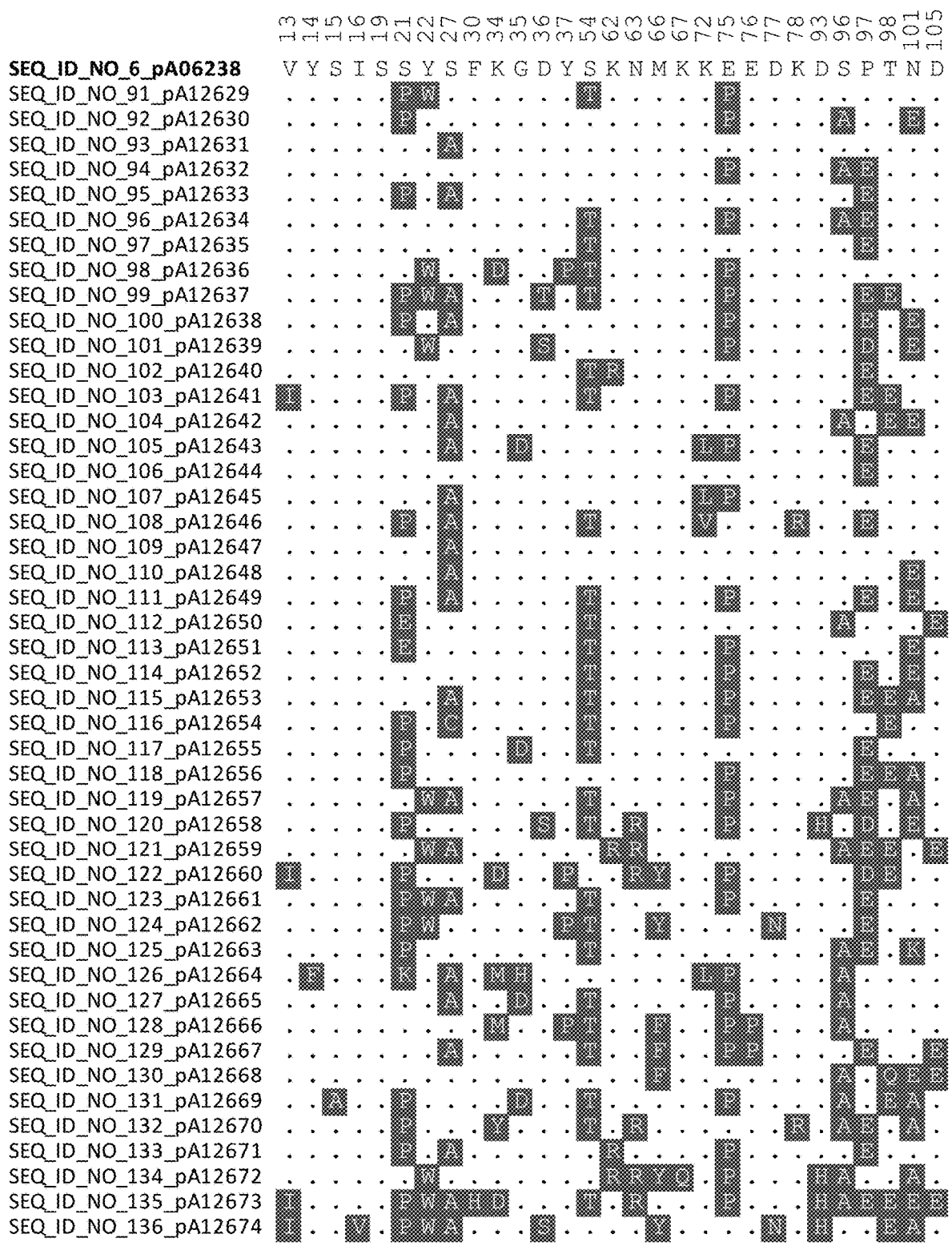
Figure 20:
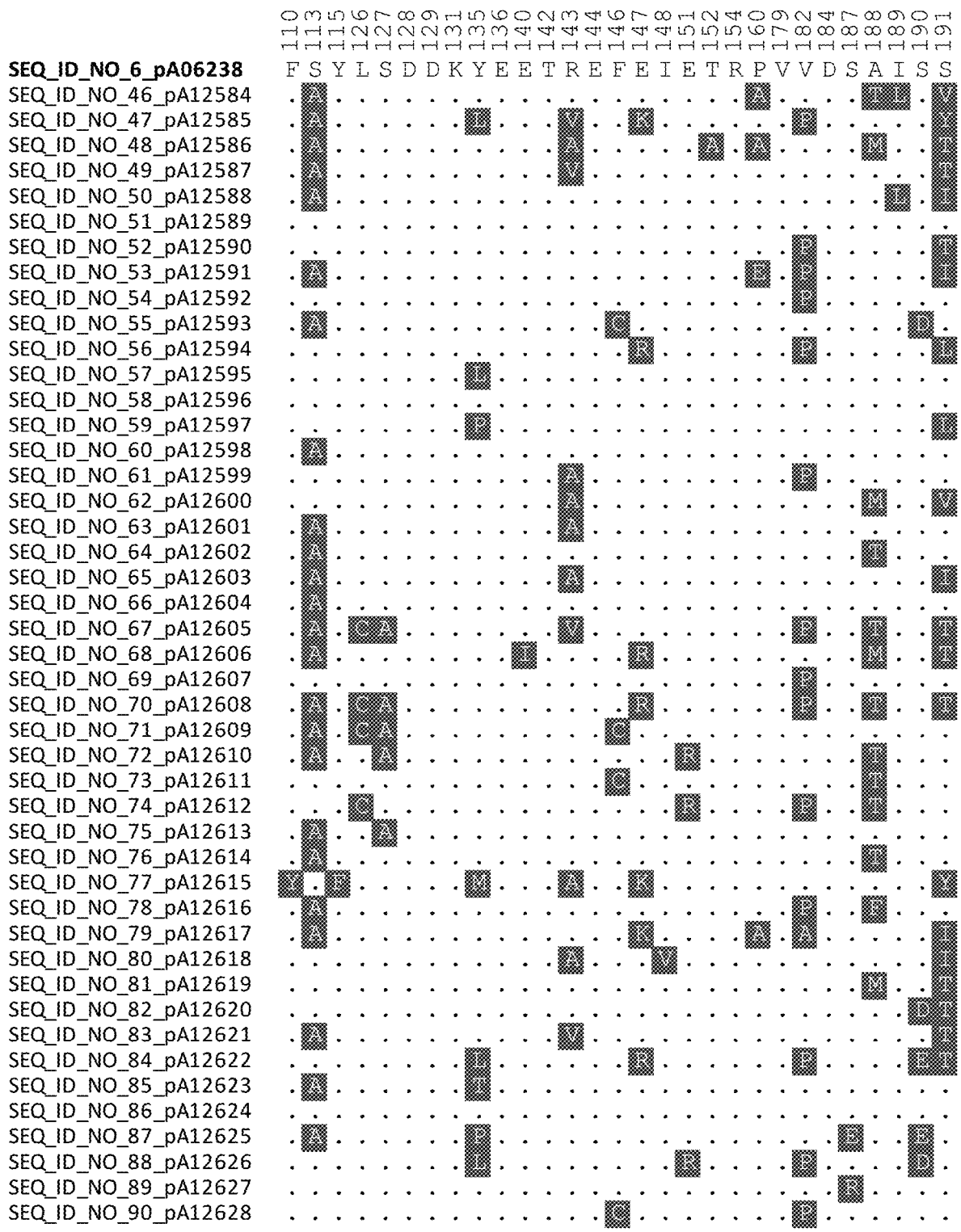
Figure 20:
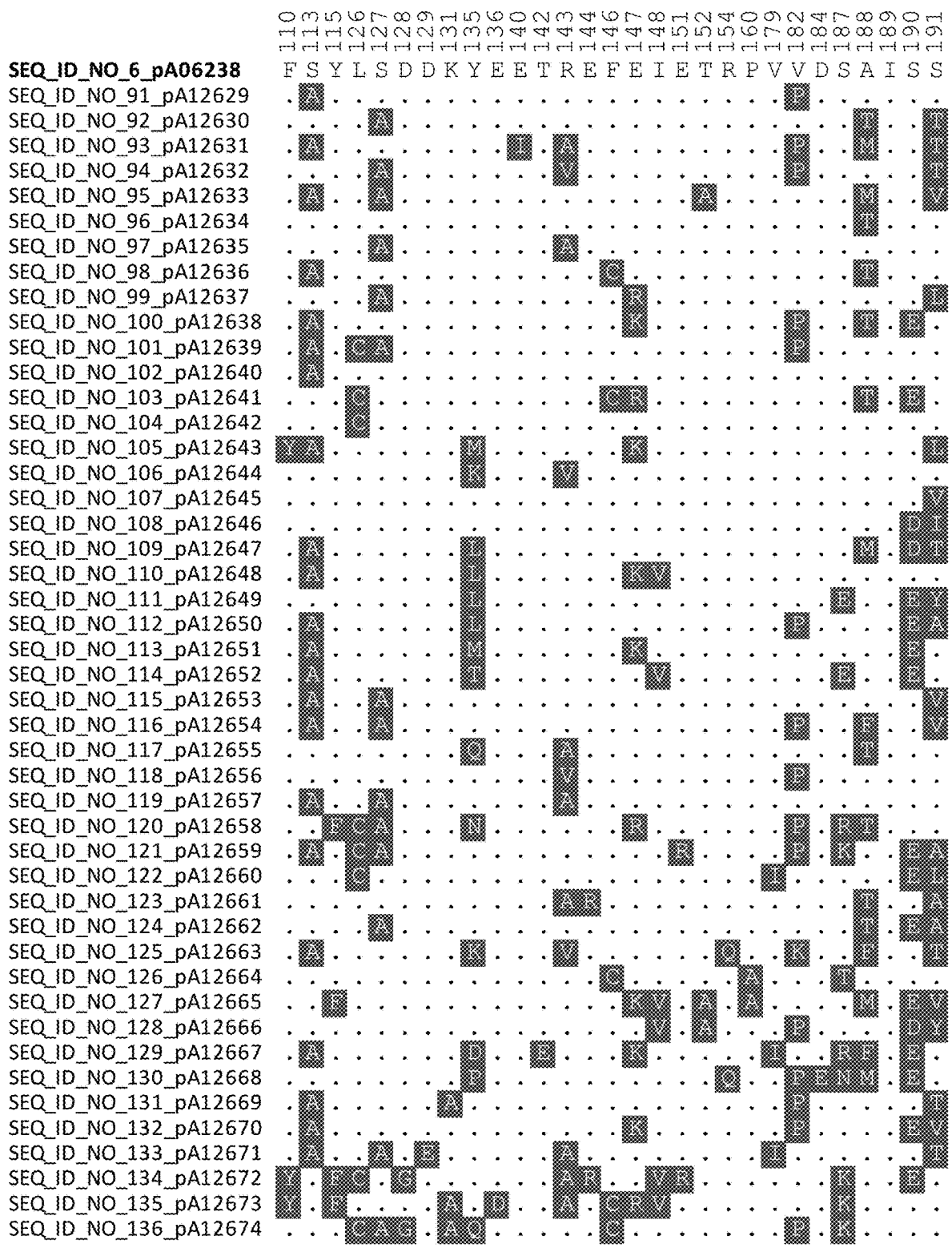
Figure 20:
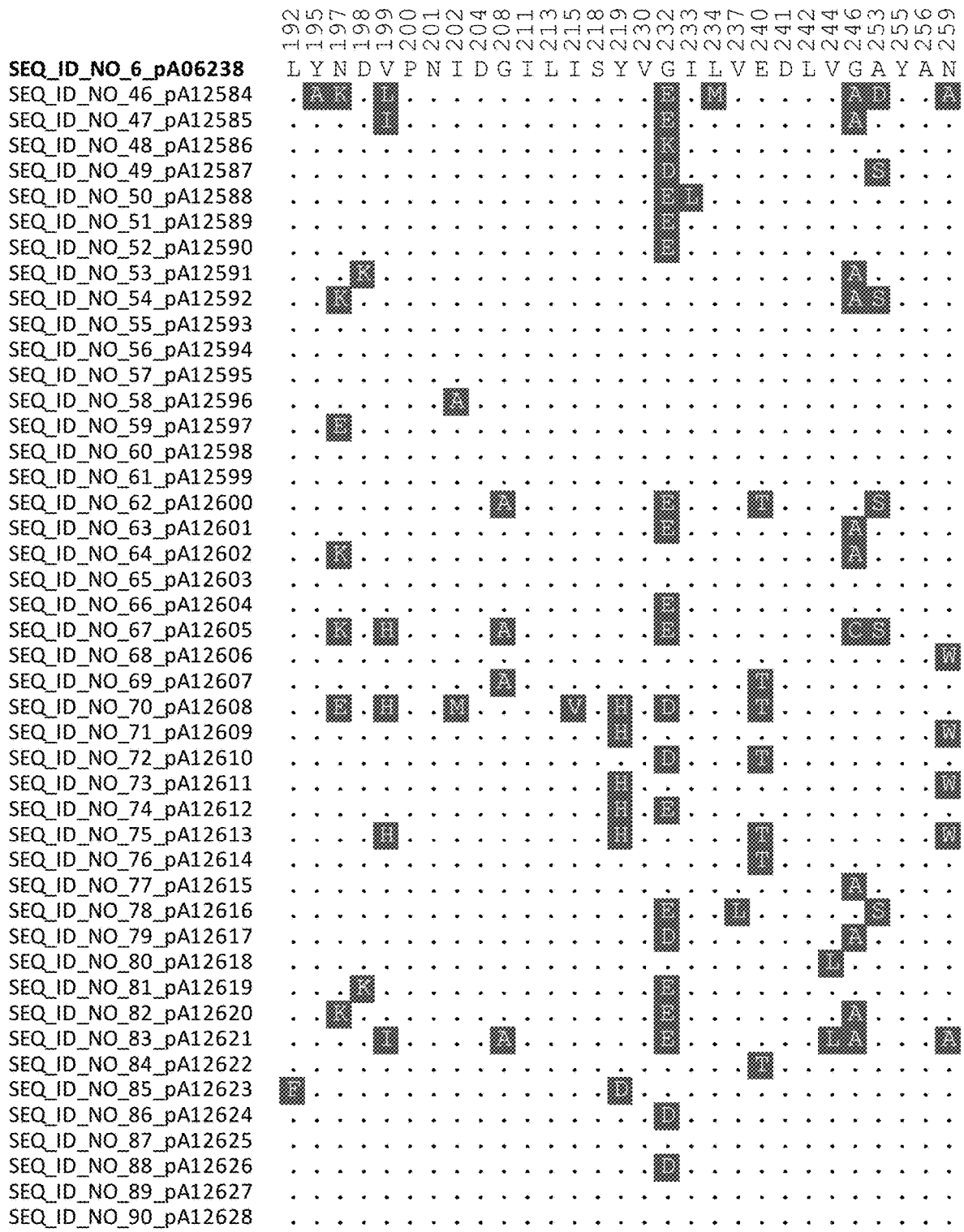
Figure 20:
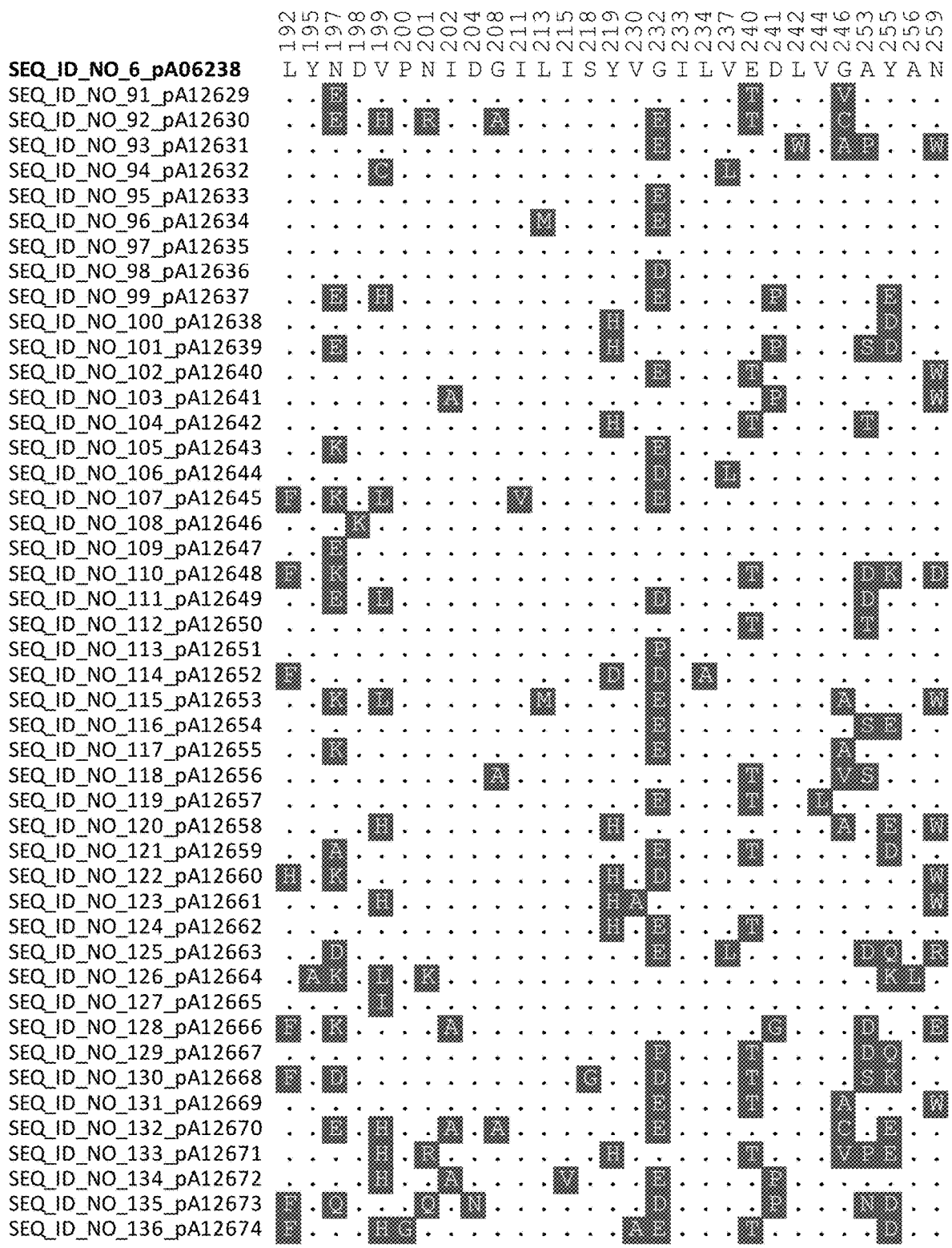
Figure 20:
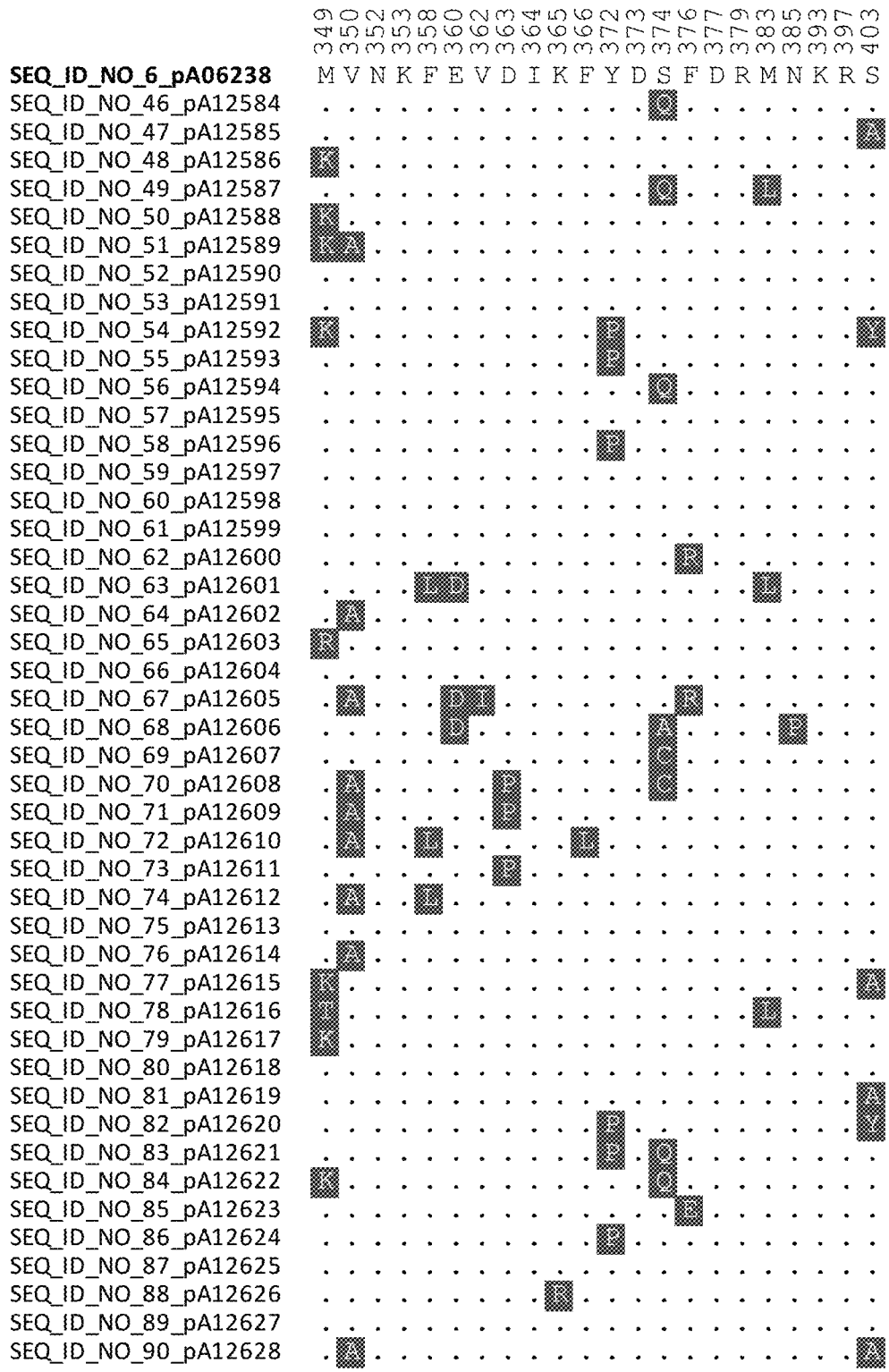
Figure 22:
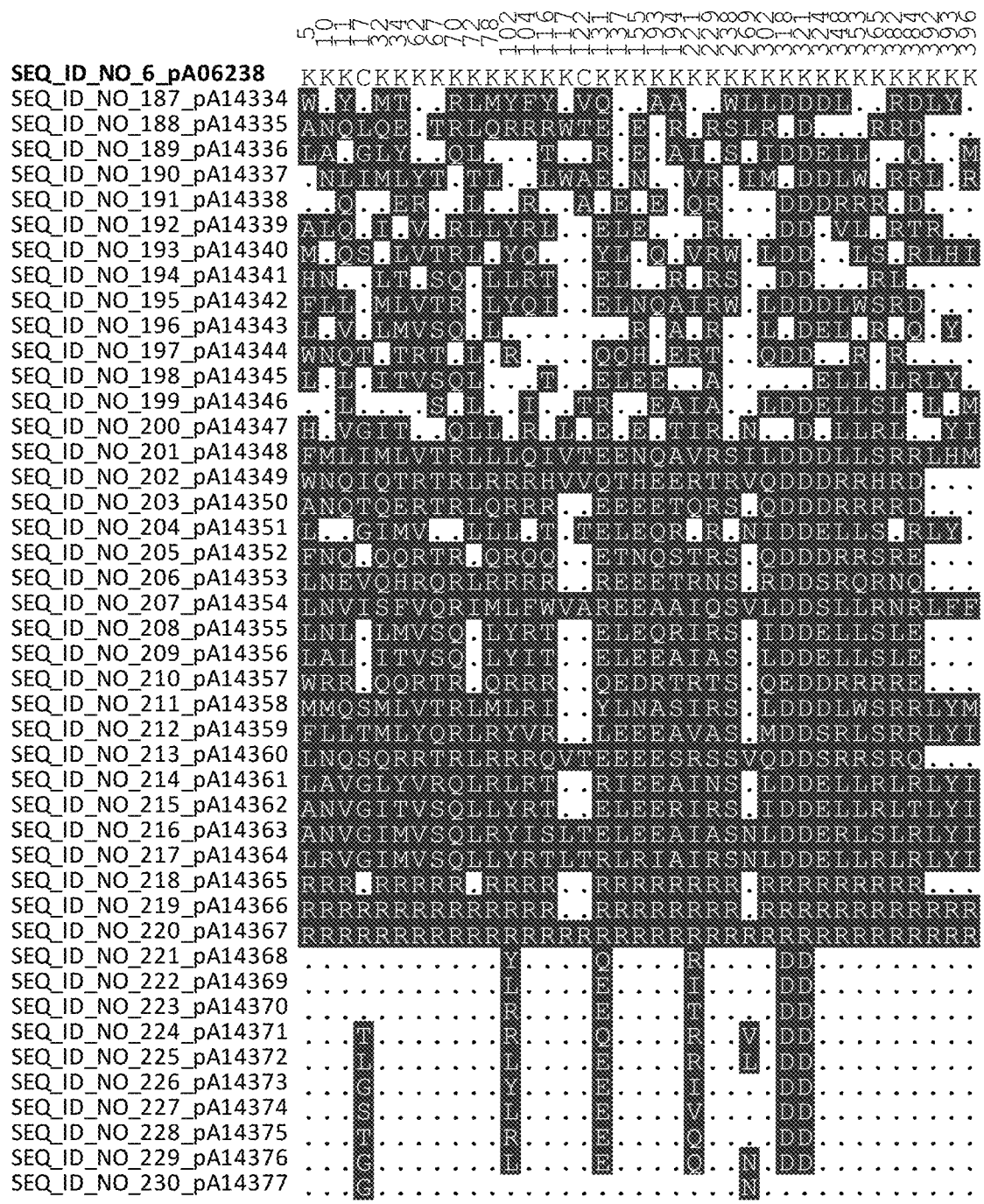
FIG. 22 depicts the sequence alignment of all lysine/cysteine only mutants from Example 14 (SEQ ID NOs 137-230). Only residue positions that were mutated in at least one mutant FC4E are shown. Amino acids that were not mutated are shown as a ".".
Figure 23:
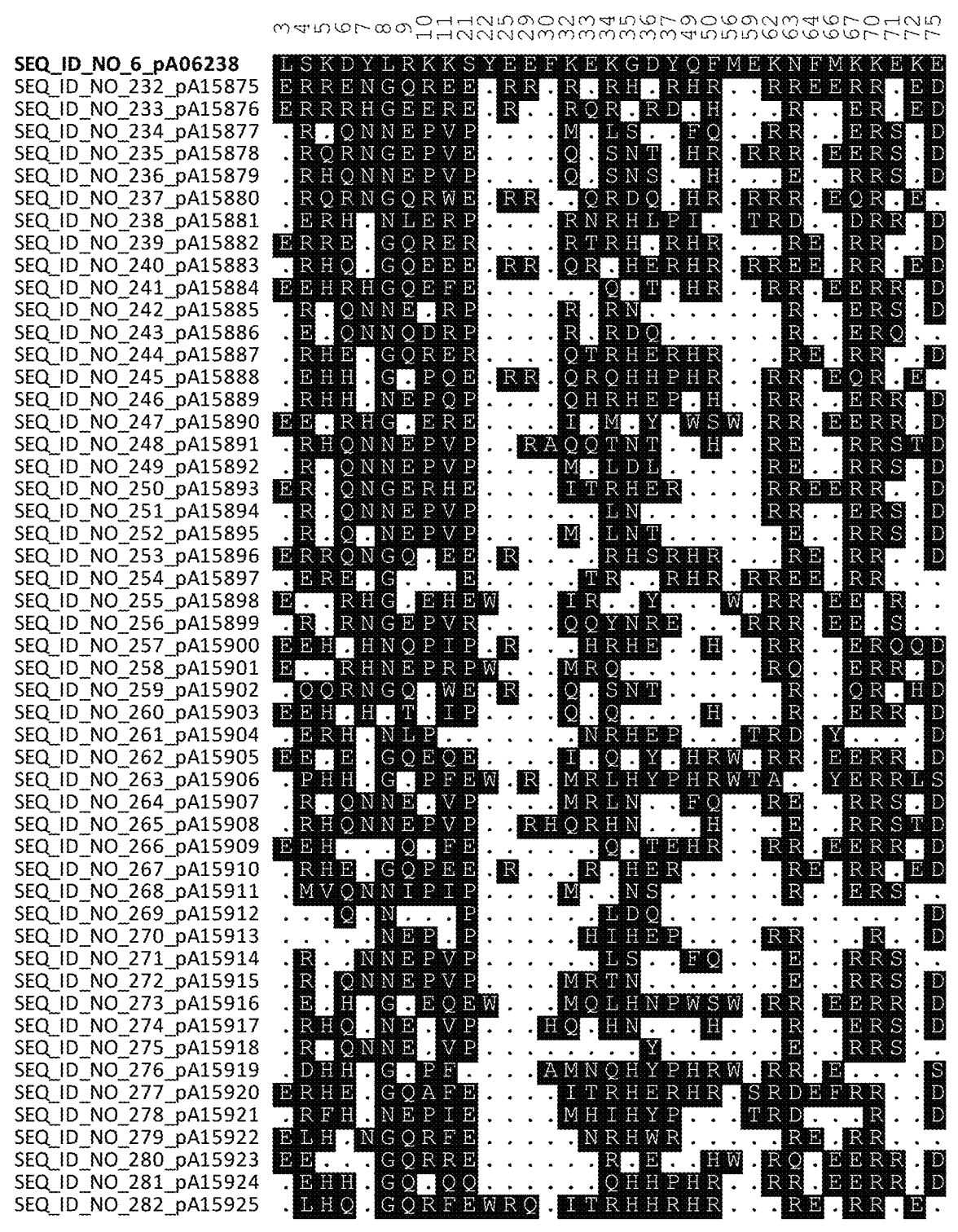
Figure 23:
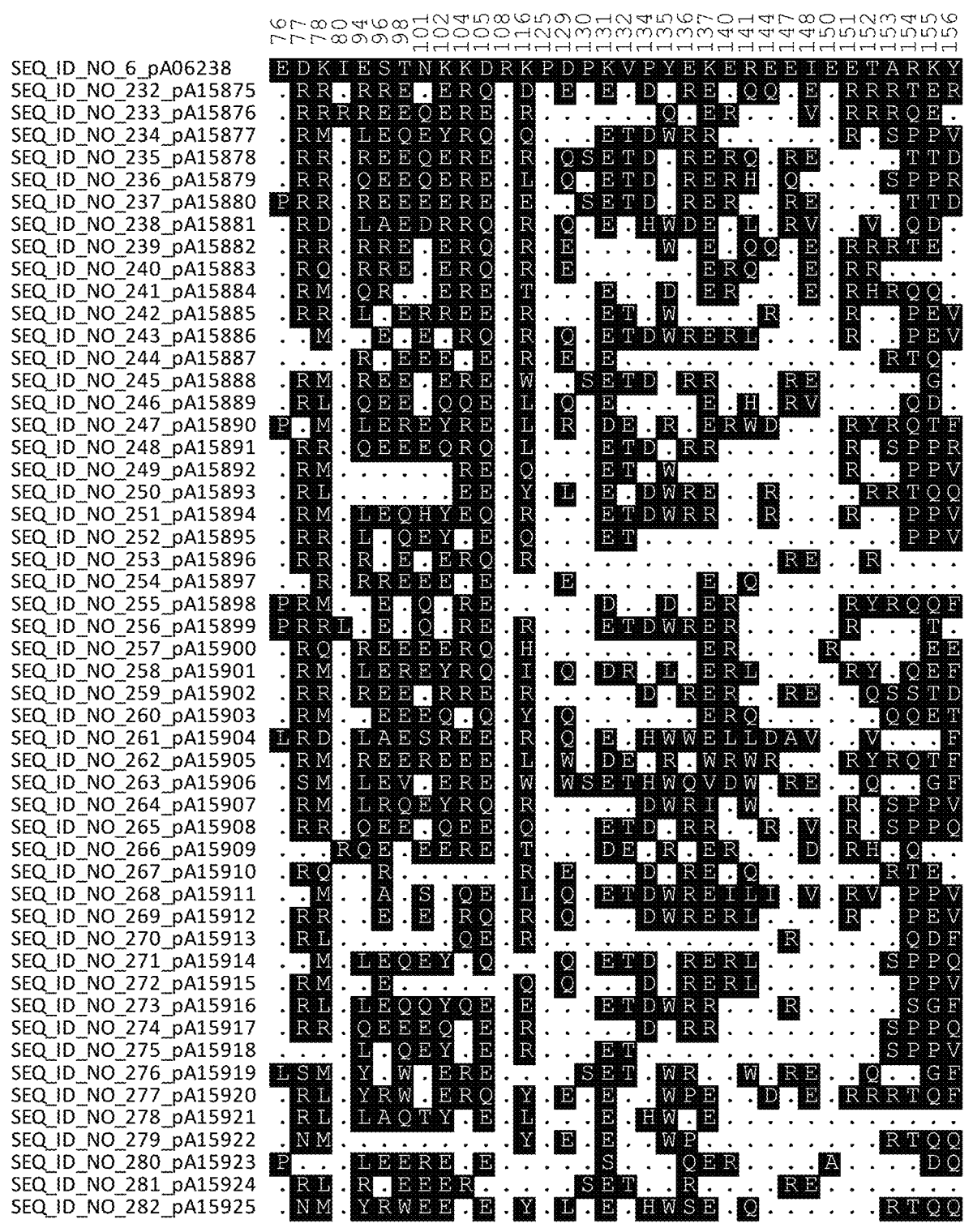
Figure 23:
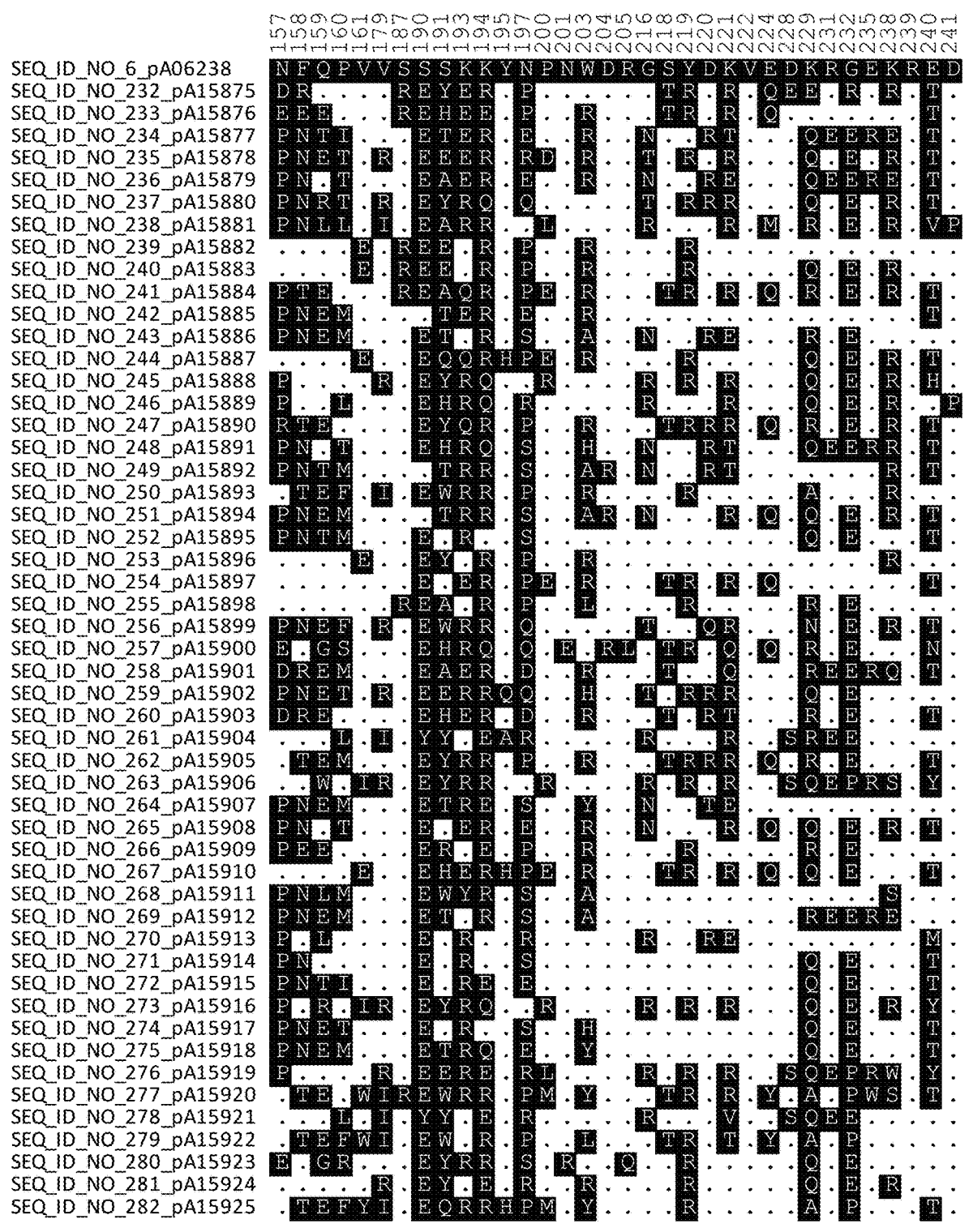
Figure 23:
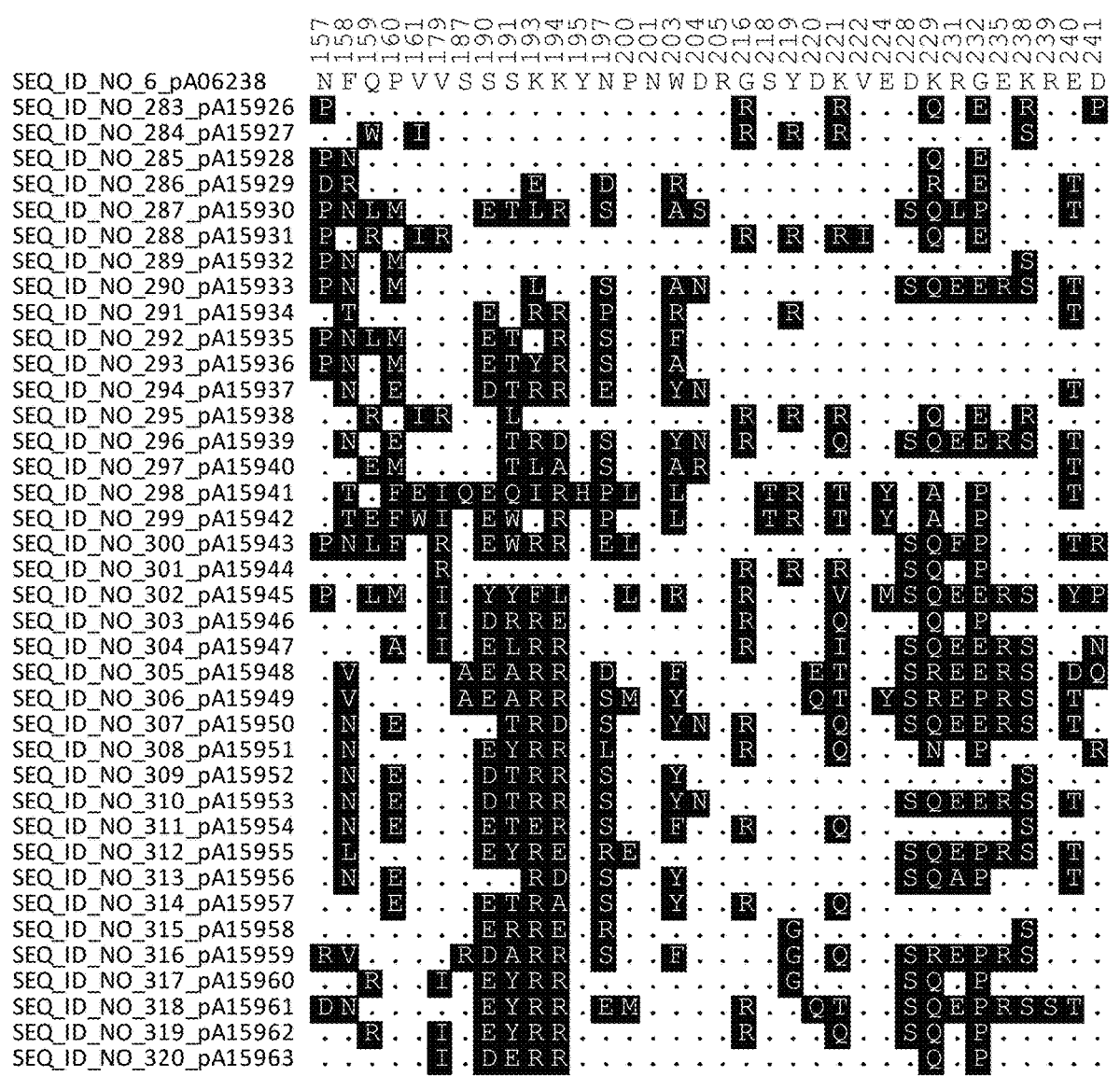
Figure 23:
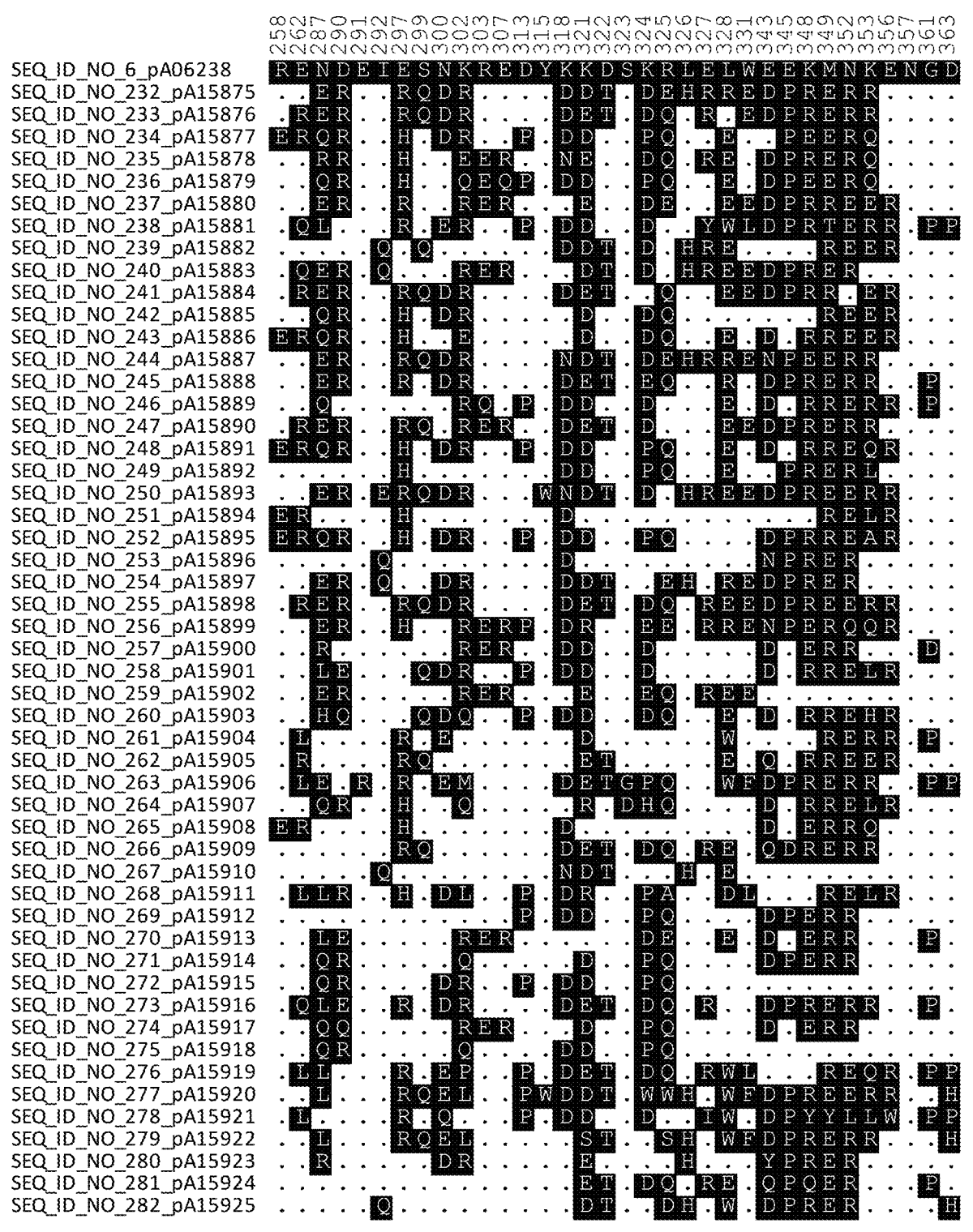
Figure 23:
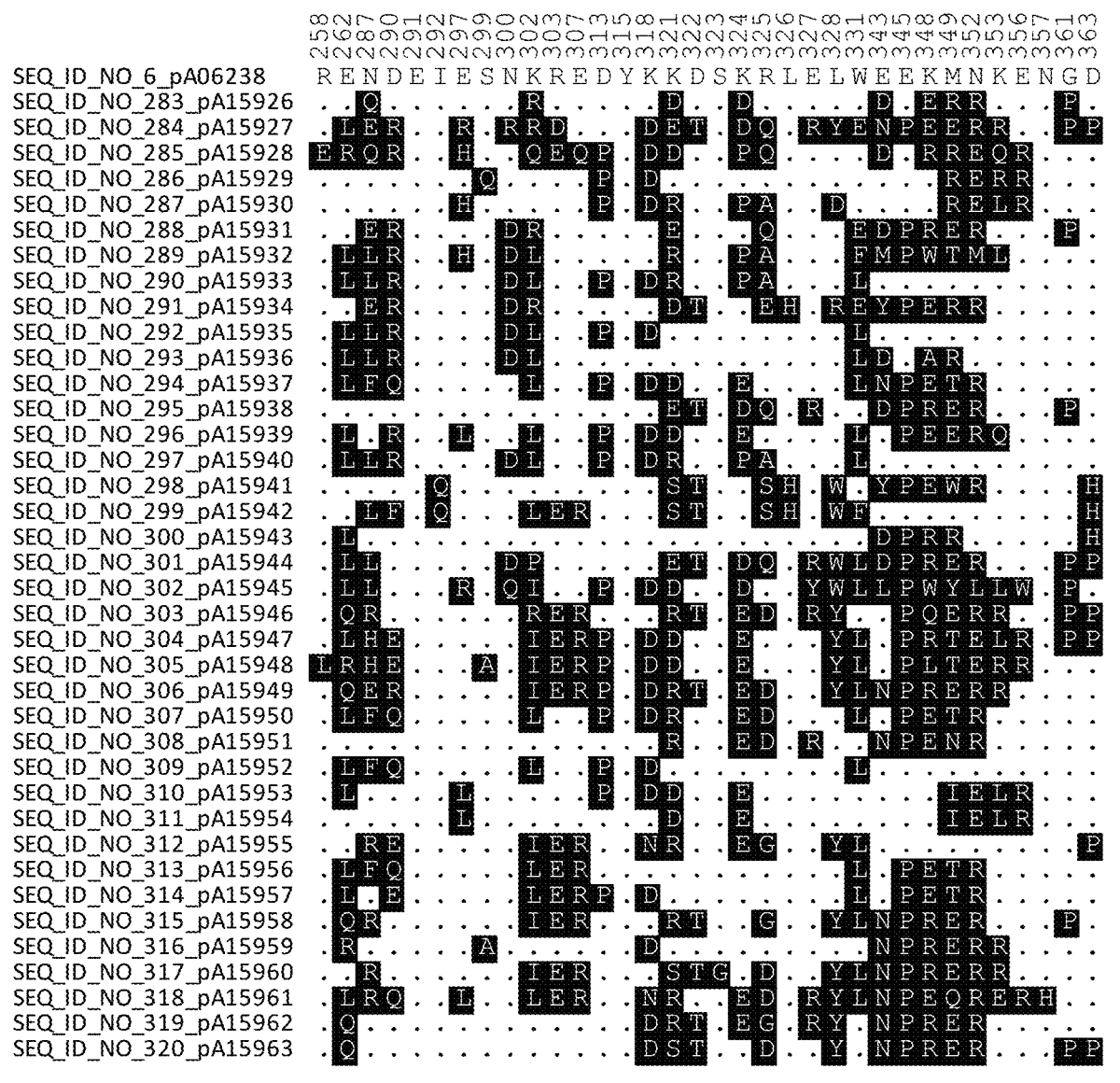
Figure 23:
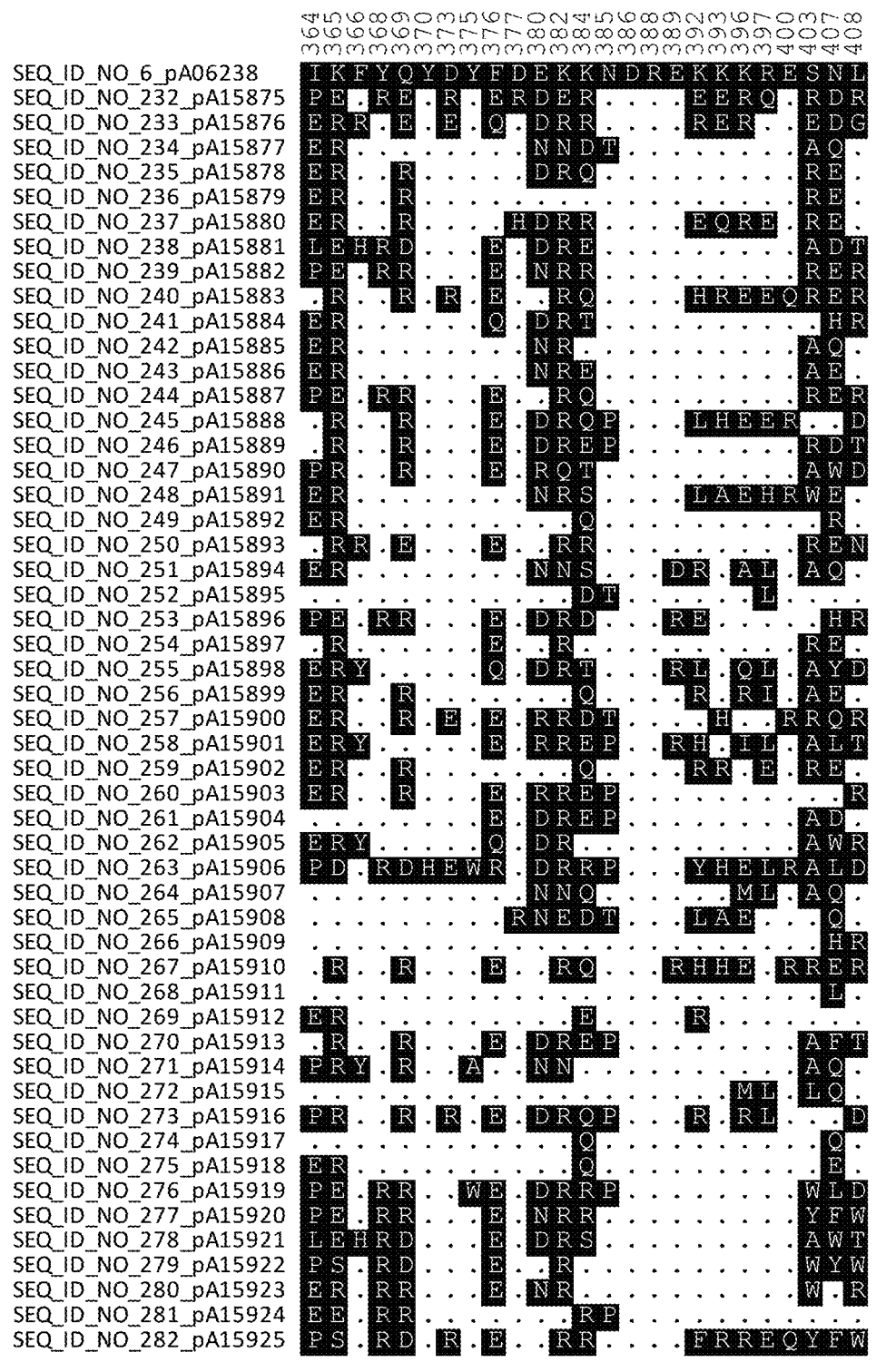
Figure 23:
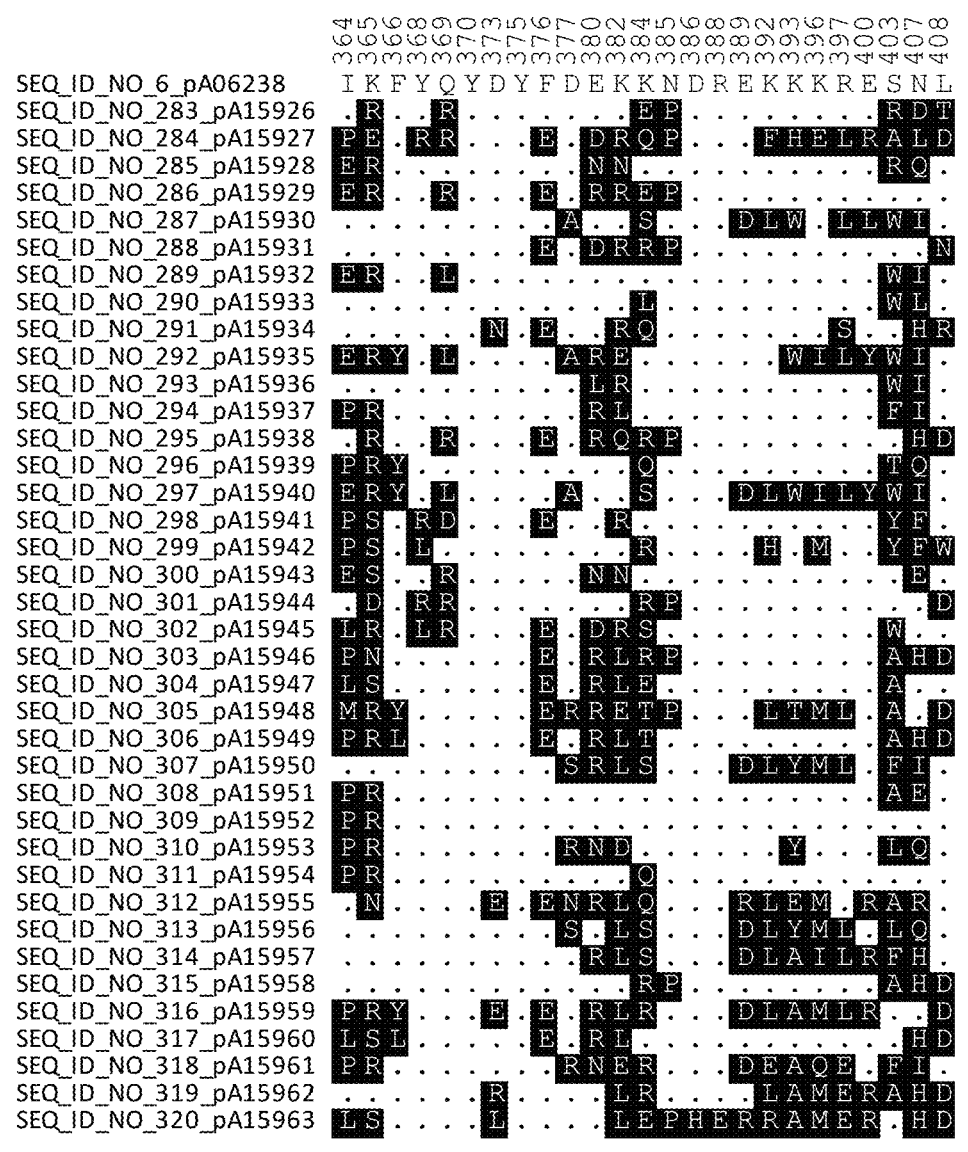

The amino acid modifications identified herein can be made in any one of the SEQ ID NOs: 1-444, or active variant or fragment thereof. The location of the amino acid modifications can be identified by referencing to SEQ ID NO: 6. Amino acid sequence alignment can be made using known methods. FIG. 17 depicts amino acid sequence alignments of the native thermophilic FC4Es (SEQ ID NOs: 1-23 and SEQ ID NOs: 321-373). FIG. 20 depicts the sequence alignment of all computationally designed stability/expression mutants from Example 13 (SEQ ID NOs 46-136). FIG. 22 depicts the sequence alignment of all lysine/cysteine only mutants from Example 14 (SEQ ID NOs 137-230). FIG. 23 depicts the sequence alignment of all lysine/cysteine mutants from Example 14 that allowed surrounding residues to mutate (SEQ ID Nos: 232-320). In some embodiments, the polypeptides carrying one or more of the amino acid modifications identified herein are capable of converting fructose to tagatose through epimerization at the carbon-4 position of fructose.

In some embodiments, the amino acid modifications are made relative to the native/wild-type sequences identified herein. In some embodiments, the polypeptide comprises an amino acid sequence having at least 60%, 65%, 70%, 75%, 80%, 85%, 90%, 95%, or 98% sequence identity to SEQ ID NO:1, and the one or more modifications are relative to SEQ ID NO:1. In some embodiments, the polypeptide has an improved D-fructose C4-epimerase activity and/or improved stability compared to the polypeptide of SEQ ID NO:1. In some embodiments, the polypeptide is derived from *Caldithrix abyssi*. In some embodiments, the polypeptide comprises an amino acid sequence having at least 60%, 65%, 70%, 75%, 80%, 85%, 90%, 95%, or 98% sequence identity to SEQ ID NO:2, and the one or more modifications are relative to SEQ ID NO:2. In some embodiments, the polypeptide has an improved D-fructose C4-epimerase activity and/or improved stability compared to the polypeptide of SEQ ID NO:2. In some embodiments, the polypeptide is derived from *Anaerolinea thermophila*. In some embodiments, the polypeptide comprises an amino acid sequence having at least 60%, 65%, 70%, 75%, 80%, 85%, 90%, 95%, or 98% sequence identity to SEQ ID NO:3, and the one or more modifications are relative to SEQ ID NO:3. In some embodiments, the polypeptide has an improved D-fructose C4-epimerase activity and/or improved stability compared to the polypeptide of SEQ ID NO:3. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:4, and the one or more modifications are relative to SEQ ID NO:4. In some embodiments, the polypeptide has an improved D-fructose C4-epimerase activity and/or improved stability compared to the polypeptide of SEQ ID NO:4. In some embodiments, the polypeptide is derived from *Thermoanaerobacter thermohydrosulfuricus*. In some embodiments, the polypeptide comprises an amino acid sequence having at least 60%, 65%, 70%, 75%, 80%, 85%, 90%, 95%, or 98% sequence identity to SEQ ID NO:5, and the one or more modifications are relative to SEQ ID NO:5. In some embodiments, the polypeptide has an improved D-fructose C4-epimerase activity and/or improved stability compared to the polypeptide of SEQ ID NO:5. In some embodiments, the polypeptide is derived from *Caldicellulosiruptor kronotskyensis*. In some embodiments, the polypeptide comprises an amino acid sequence having at least 60%, 65%, 70%, 75%, 80%, 85%, 90%, 95%, or 98% sequence identity to SEQ ID NO:6, and the one or more modifications are relative to SEQ ID NO:6. In some embodiments, the polypeptide has an improved D-fructose C4-epimerase activity and/or improved stability compared to the polypeptide of SEQ ID NO:6. In some embodiments, the polypeptide is derived from *Dictyoglomus turgidum*. In some embodiments, the polypeptide comprises an amino acid sequence having at least 60%, 65%, 70%, 75%, 80%, 85%, 90%, 95%, or 98% sequence identity to SEQ ID NO:7, and the one or more modifications are relative to SEQ ID NO:7. In some embodiments, the polypeptide has an improved D-fructose C4-epimerase activity and/or improved stability compared to the polypeptide of SEQ ID NO:7. In some embodiments, the polypeptide is derived from *Caldilinea aerophila*. In some embodiments, the polypeptide comprises an amino acid sequence having at least 60%, 65%, 70%, 75%, 80%, 85%, 90%, 95%, or 98% sequence identity to SEQ ID NO:8, and the one or more modifications are relative to SEQ ID NO:8. In some embodiments, the polypeptide has an improved D-fructose C4-epimerase activity and/or improved stability compared to the polypeptide of SEQ ID NO:8. In some embodiments, the polypeptide is derived from *Rhodothermus marinus*. In some embodiments, the polypeptide comprises an amino acid sequence having at least 60%, 65%, 70%, 75%, 80%, 85%, 90%, 95%, or 98% sequence identity to SEQ ID NO:9, and the one or more modifications are relative to SEQ ID NO:9. In some embodiments, the polypeptide has an improved D-fructose C4-epimerase activity and/or improved stability compared to the polypeptide of SEQ ID NO:9. In some embodiments, the polypeptide is derived from *Methanohalobium evestigatum*. In some embodiments, the polypeptide comprises an amino acid sequence having at least 60%, 65%, 70%, 75%, 80%, 85%, 90%, 95%, or 98% sequence identity to SEQ ID NO:10, and the one or more modifications are relative to SEQ ID NO:10. In some embodiments, the polypeptide has an improved D-fructose C4-epimerase activity and/or improved stability compared to the polypeptide of SEQ ID NO:10. In some embodiments, the polypeptide is derived from *Thermoanaerobacter thermohydrosulfuricus*.

In some embodiments, the polypeptide comprises an amino acid sequence having at least 60%, 65%, 70%, 75%, 80%, 85%, 90%, 95%, or 98% sequence identity to SEQ ID NO:11, and the one or more modifications are relative to SEQ ID NO:11. In some embodiments, the polypeptide has an improved D-fructose C4-epimerase activity and/or improved stability compared to the polypeptide of SEQ ID NO:11. In some embodiments, the polypeptide is derived from *Clostridium cavendishii*. In some embodiments, the polypeptide comprises an amino acid sequence having at least 60%, 65%, 70%, 75%, 80%, 85%, 90%, 95%, or 98% sequence identity to SEQ ID NO:12, and the one or more modifications are relative to SEQ ID NO:12. In some embodiments, the polypeptide has an improved D-fructose C4-epimerase activity and/or improved stability compared to the polypeptide of SEQ ID NO:12. In some embodiments, the polypeptide is derived from *Kosmotoga olearia*. In some embodiments, the polypeptide comprises an amino acid sequence having at least 60%, 65%, 70%, 75%, 80%, 85%, 90%, 95%, or 98% sequence identity to SEQ ID NO:13, and the one or more modifications are relative to SEQ ID NO:13. In some embodiments, the polypeptide has an improved D-fructose C4-epimerase activity and/or improved stability compared to the polypeptide of SEQ ID NO:13. In some embodiments, the polypeptide is derived from *Butyricicoccus pullicaecorum*. In some embodiments, the polypeptide comprises an amino acid sequence having at least 60%, 65%, 70%, 75%, 80%, 85%, 90%, 95%, or 98% sequence identity to SEQ ID NO:14, and the one or more modifications are relative to SEQ ID NO:14. In some embodiments, the polypeptide has an improved D-fructose C4-epimerase activity and/or improved stability compared to the polypeptide of SEQ ID NO:14. In some embodiments, the polypeptide is derived from *Clostridium thermobutyricum*. In some embodiments, the polypeptide comprises an amino acid sequence having at least 60%, 65%, 70%, 75%, 80%, 85%, 90%, 95%, or 98% sequence identity to SEQ ID NO:15, and the one or more modifications are relative to SEQ ID NO:15. In some embodiments, the polypeptide has an improved D-fructose C4-epimerase activity and/or improved stability compared to the polypeptide of SEQ ID NO:15. In some embodiments, the polypeptide is derived from *Litorilinea aerophila*. In some embodiments, the polypeptide comprises an amino acid sequence having at least 60%, 65%, 70%, 75%, 80%, 85%, 90%, 95%, or 98% sequence identity to SEQ ID NO:16, and the one or more modifications are relative to SEQ ID NO:16. In some embodiments, the polypeptide has an improved D-fructose C4-epimerase activity and/or improved stability compared to the polypeptide of SEQ ID NO:16. In some embodiments, the polypeptide is derived from *Enterobacter mori*. In some embodiments, the polypeptide comprises an amino acid sequence having at least 60%, 65%, 70%, 75%, 80%, 85%, 90%, 95%, or 98% sequence identity to SEQ ID NO:17, and the one or more modifications are relative to SEQ ID NO:17. In some embodiments, the polypeptide has an improved D-fructose C4-epimerase activity and/or improved stability compared to the polypeptide of SEQ ID NO:17. In some embodiments, the polypeptide is derived from *Caldisericum exile*. In some embodiments, the polypeptide comprises an amino acid sequence having at least 60%, 65%, 70%, 75%, 80%, 85%, 90%, 95%, or 98% sequence identity to SEQ ID NO:18, and the one or more modifications are relative to SEQ ID NO:18. In some embodiments, the polypeptide has an improved D-fructose C4-epimerase activity and/or improved stability compared to the polypeptide of SEQ ID NO:18. In some embodiments, the polypeptide is derived from *Dictyoglomus thermophilum*. In some embodiments, the polypeptide comprises an amino acid sequence having at least 60%, 65%, 70%, 75%, 80%, 85%, 90%, 95%, or 98% sequence identity to SEQ ID NO:19, and the one or more modifications are relative to SEQ ID NO:19. In some embodiments, the polypeptide has an improved D-fructose C4-epimerase activity and/or improved stability compared to the polypeptide of SEQ ID NO:19. In some embodiments, the polypeptide is derived from *Rhodothermus marinus*. In some embodiments, the polypeptide comprises an amino acid sequence having at least 60%, 65%, 70%, 75%, 80%, 85%, 90%, 95%, or 98% sequence identity to SEQ ID NO:20, and the one or more modifications are relative to SEQ ID NO:20. In some embodiments, the polypeptide has an improved D-fructose C4-epimerase activity and/or improved stability compared to the polypeptide of SEQ ID NO:20.

In some embodiments, the polypeptide is derived from *Rhodothermus profundi*. In some embodiments, the polypeptide comprises an amino acid sequence having at least 60%, 65%, 70%, 75%, 80%, 85%, 90%, 95%, or 98% sequence identity to SEQ ID NO:21, and the one or more modifications are relative to SEQ ID NO:21. In some embodiments, the polypeptide has an improved D-fructose C4-epimerase activity and/or improved stability compared to the polypeptide of SEQ ID NO:21. In some embodiments, the polypeptide is derived from *Caldibacillus debilis*. In some embodiments, the polypeptide comprises an amino acid sequence having at least 60%, 65%, 70%, 75%, 80%, 85%, 90%, 95%, or 98% sequence identity to SEQ ID NO:22, and the one or more modifications are relative to SEQ ID NO:22. In some embodiments, the polypeptide has an improved D-fructose C4-epimerase activity and/or improved stability compared to the polypeptide of SEQ ID NO:22. In some embodiments, the polypeptide is derived from *Caloramator quimbayensis*. In some embodiments, the polypeptide comprises an amino acid sequence having at least 60%, 65%, 70%, 75%, 80%, 85%, 90%, 95%, or 98% sequence identity to SEQ ID NO:23, and the one or more modifications are relative to SEQ ID NO:23. In some embodiments, the polypeptide has an improved D-fructose C4-epimerase activity and/or improved stability compared to the polypeptide of SEQ ID NO:23.

In some embodiments, the polypeptide is derived from *Methanosalsum zhilinae*. In some embodiments, the polypeptide comprises an amino acid sequence having at least 60%, 65%, 70%, 75%, 80%, 85%, 90%, 95%, or 98% sequence identity to SEQ ID NO:321, and the one or more modifications are relative to SEQ ID NO:321. In some embodiments, the polypeptide has an improved D-fructose C4-epimerase activity and/or improved stability compared to the polypeptide of SEQ ID NO:321. In some embodiments, the polypeptide is derived from *Pseudothermotoga thermarum*. In some embodiments, the polypeptide comprises an amino acid sequence having at least 60%, 65%, 70%, 75%, 80%, 85%, 90%, 95%, or 98% sequence identity to SEQ ID NO:322, and the one or more modifications are relative to SEQ ID NO:322. In some embodiments, the polypeptide has an improved D-fructose C4-epimerase activity and/or improved stability compared to the polypeptide of SEQ ID NO:322. In some embodiments, the polypeptide is derived from *Pseudothermotoga hypogea*. In some embodiments, the polypeptide comprises an amino acid sequence having at least 60%, 65%, 70%, 75%, 80%, 85%, 90%, 95%, or 98% sequence identity to SEQ ID NO:323, and the one or more modifications are relative to SEQ ID NO:323. In some embodiments, the polypeptide has an improved D-fructose C4-epimerase activity and/or improved stability compared to the polypeptide of SEQ ID NO:323. In some embodiments, the polypeptide is derived from *Pseudothermotoga lettingae*. In some embodiments, the polypeptide comprises an amino acid sequence having at least 60%, 65%, 70%, 75%, 80%, 85%, 90%, 95%, or 98% sequence identity to SEQ ID NO:324, and the one or more modifications are relative to SEQ ID NO:324. In some embodiments, the polypeptide has an improved D-fructose C4-epimerase activity and/or improved stability compared to the polypeptide of SEQ ID NO:324. In some embodiments, the polypeptide is derived from *Rhodothermus marinus*. In some embodiments, the polypeptide comprises an amino acid sequence having at least 60%, 65%, 70%, 75%, 80%, 85%, 90%, 95%, or 98% sequence identity to SEQ ID NO:325, and the one or more modifications are relative to SEQ ID NO:325. In some embodiments, the polypeptide has an improved D-fructose C4-epimerase activity and/or improved stability compared to the polypeptide of SEQ ID NO:325. In some embodiments, the polypeptide is derived from *Geosporobacter subterraneus*. In some embodiments, the polypeptide comprises an amino acid sequence having at least 60%, 65%, 70%, 75%, 80%, 85%, 90%, 95%, or 98% sequence identity to SEQ ID NO:326, and the one or more modifications are relative to SEQ ID NO:326. In some embodiments, the polypeptide has an improved D-fructose C4-epimerase activity and/or improved stability compared to the polypeptide of SEQ ID NO:326. In some embodiments, the polypeptide is derived from *Melioribacter roseus*. In some embodiments, the polypeptide comprises an amino acid sequence having at least 60%, 65%, 70%, 75%, 80%, 85%, 90%, 95%, or 98% sequence identity to SEQ ID NO:327, and the one or more modifications are relative to SEQ ID NO:327. In some embodiments, the polypeptide has an improved D-fructose C4-epimerase activity and/or improved stability compared to the polypeptide of SEQ ID NO:327. In some embodiments, the polypeptide is derived from *Lysinibacillus sphaericus*. In some embodiments, the polypeptide comprises an amino acid sequence having at least 60%, 65%, 70%, 75%, 80%, 85%, 90%, 95%, or 98% sequence identity to SEQ ID NO:328, and the one or more modifications are relative to SEQ ID NO:328. In some embodiments, the polypeptide has an improved D-fructose C4-epimerase activity and/or improved stability compared to the polypeptide of SEQ ID NO:328. In some embodiments, the polypeptide is derived from *Clostridium stercorarium*. In some embodiments, the polypeptide comprises an amino acid sequence having at least 60%, 65%, 70%, 75%, 80%, 85%, 90%, 95%, or 98% sequence identity to SEQ ID NO:329, and the one or more modifications are relative to SEQ ID NO:329. In some embodiments, the polypeptide has an improved D-fructose C4-epimerase activity and/or improved stability compared to the polypeptide of SEQ ID NO:329. In some embodiments, the polypeptide is derived from *Truepera radiovictrix*. In some embodiments, the polypeptide comprises an amino acid sequence having at least 60%, 65%, 70%, 75%, 80%, 85%, 90%, 95%, or 98% sequence identity to SEQ ID NO:330, and the one or more modifications are relative to SEQ ID NO:330. In some embodiments, the polypeptide has an improved D-fructose C4-epimerase activity and/or improved stability compared to the polypeptide of SEQ ID NO:330. In some embodiments, the polypeptide is derived from *Dictyoglomus turgidum*. In some embodiments, the polypeptide comprises an amino acid sequence having at least 60%, 65%, 70%, 75%, 80%, 85%, 90%, 95%, or 98% sequence identity to SEQ ID NO:331, and the one or more modifications are relative to SEQ ID NO:331. In some embodiments, the polypeptide has an improved D-fructose C4-epimerase activity and/or improved stability compared to the polypeptide of SEQ ID NO:331. In some embodiments, the polypeptide is derived from *Caldilinea aerophila*. In some embodiments, the polypeptide comprises an amino acid sequence having at least 60%, 65%, 70%, 75%, 80%, 85%, 90%, 95%, or 98% sequence identity to SEQ ID NO:332, and the one or more modifications are relative to SEQ ID NO:332. In some embodiments, the polypeptide has an improved D-fructose C4-epimerase activity and/or improved stability compared to the polypeptide of SEQ ID NO:332. In some embodiments, the polypeptide is derived from *Thermoflexus hugenholtzii*. In some embodiments, the polypeptide comprises an amino acid sequence having at least 60%, 65%, 70%, 75%, 80%, 85%, 90%, 95%, or 98% sequence identity to SEQ ID NO:333, and the one or more modifications are relative to SEQ ID NO:333. In some embodiments, the polypeptide has an improved D-fructose C4-epimerase activity and/or improved stability compared to the polypeptide of SEQ ID NO:333. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:334, and the one or more modifications are relative to SEQ ID NO:334. In some embodiments, the polypeptide has an improved D-fructose C4-epimerase activity and/or improved stability compared to the polypeptide of SEQ ID NO:334. In some embodiments, the polypeptide is derived from *Petrotoga mobilis*. In some embodiments, the polypeptide comprises an amino acid sequence having at least 60%, 65%, 70%, 75%, 80%, 85%, 90%, 95%, or 98% sequence identity to SEQ ID NO:335, and the one or more modifications are relative to SEQ ID NO:335. In some embodiments, the polypeptide has an improved D-fructose C4-epimerase activity and/or improved stability compared to the polypeptide of SEQ ID NO:335. In some embodiments, the polypeptide is derived from *Spirochaeta thermophila*. In some embodiments, the polypeptide comprises an amino acid sequence having at least 60%, 65%, 70%, 75%, 80%, 85%, 90%, 95%, or 98% sequence identity to SEQ ID NO:336, and the one or more modifications are relative to SEQ ID NO:336. In some embodiments, the polypeptide has an improved D-fructose C4-epimerase activity and/or improved stability compared to the polypeptide of SEQ ID NO:336. In some embodiments, the polypeptide is derived from *Thermofilum pendens*.

In some embodiments, the polypeptide comprises an amino acid sequence having at least 60%, 65%, 70%, 75%, 80%, 85%, 90%, 95%, or 98% sequence identity to SEQ ID NO:337, and the one or more modifications are relative to SEQ ID NO:337. In some embodiments, the polypeptide has an improved D-fructose C4-epimerase activity and/or improved stability compared to the polypeptide of SEQ ID NO:337. In some embodiments, the polypeptide is derived from *Rhodothermus marinus*. In some embodiments, the polypeptide comprises an amino acid sequence having at least 60%, 65%, 70%, 75%, 80%, 85%, 90%, 95%, or 98% sequence identity to SEQ ID NO:338, and the one or more modifications are relative to SEQ ID NO:338. In some embodiments, the polypeptide has an improved D-fructose C4-epimerase activity and/or improved stability compared to the polypeptide of SEQ ID NO:338. In some embodiments, the polypeptide is derived from *Dictyoglomus thermophilum*. In some embodiments, the polypeptide comprises an amino acid sequence having at least 60%, 65%, 70%, 75%, 80%, 85%, 90%, 95%, or 98% sequence identity to SEQ ID NO:339, and the one or more modifications are relative to SEQ ID NO:339. In some embodiments, the polypeptide has an improved D-fructose C4-epimerase activity and/or improved stability compared to the polypeptide of SEQ ID NO:339. In some embodiments, the polypeptide is derived from *Thermoanaerobacter siderophilus*. In some embodiments, the polypeptide comprises an amino acid sequence having at least 60%, 65%, 70%, 75%, 80%, 85%, 90%, 95%, or 98% sequence identity to SEQ ID NO:340, and the one or more modifications are relative to SEQ ID NO:340. In some embodiments, the polypeptide has an improved D-fructose C4-epimerase activity and/or improved stability compared to the polypeptide of SEQ ID NO:340.

In some embodiments, the polypeptide is derived from *Thermoanaerobacter mathranii*. In some embodiments, the polypeptide comprises an amino acid sequence having at least 60%, 65%, 70%, 75%, 80%, 85%, 90%, 95%, or 98% sequence identity to SEQ ID NO:341, and the one or more modifications are relative to SEQ ID NO:341. In some embodiments, the polypeptide has an improved D-fructose C4-epimerase activity and/or improved stability compared to the polypeptide of SEQ ID NO:341. In some embodiments, the polypeptide is derived from *Thermoanaerobacter*

*italicus*. In some embodiments, the polypeptide comprises an amino acid sequence having at least 60%, 65%, 70%, 75%, 80%, 85%, 90%, 95%, or 98% sequence identity to SEQ ID NO:342, and the one or more modifications are relative to SEQ ID NO:342. In some embodiments, the polypeptide has an improved D-fructose C4-epimerase activity and/or improved stability compared to the polypeptide of SEQ ID NO:342. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:343, and the one or more modifications are relative to SEQ ID NO:343. In some embodiments, the polypeptide has an improved D-fructose C4-epimerase activity and/or improved stability compared to the polypeptide of SEQ ID NO:343. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:344, and the one or more modifications are relative to SEQ ID NO:344. In some embodiments, the polypeptide has an improved D-fructose C4-epimerase activity and/or improved stability compared to the polypeptide of SEQ ID NO:344. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:345, and the one or more modifications are relative to SEQ ID NO:345. In some embodiments, the polypeptide has an improved D-fructose C4-epimerase activity and/or improved stability compared to the polypeptide of SEQ ID NO:345. In some embodiments, the polypeptide is derived from *Thermoanaerobacterium thermosaccharolyticum*. In some embodiments, the polypeptide comprises an amino acid sequence having at least 60%, 65%, 70%, 75%, 80%, 85%, 90%, 95%, or 98% sequence identity to SEQ ID NO:346, and the one or more modifications are relative to SEQ ID NO:346. In some embodiments, the polypeptide has an improved D-fructose C4-epimerase activity and/or improved stability compared to the polypeptide of SEQ ID NO:346. In some embodiments, the polypeptide is derived from *Thermoanaerobacterium xylanolyticum*. In some embodiments, the polypeptide comprises an amino acid sequence having at least 60%, 65%, 70%, 75%, 80%, 85%, 90%, 95%, or 98% sequence identity to SEQ ID NO:347, and the one or more modifications are relative to SEQ ID NO:347. In some embodiments, the polypeptide has an improved D-fructose C4-epimerase activity and/or improved stability compared to the polypeptide of SEQ ID NO:347. In some embodiments, the polypeptide is derived from *Petrotoga mobilis*. In some embodiments, the polypeptide comprises an amino acid sequence having at least 60%, 65%, 70%, 75%, 80%, 85%, 90%, 95%, or 98% sequence identity to SEQ ID NO:348, and the one or more modifications are relative to SEQ ID NO:348. In some embodiments, the polypeptide has an improved D-fructose C4-epimerase activity and/or improved stability compared to the polypeptide of SEQ ID NO:348. In some embodiments, the polypeptide is derived from *Thermoanaerobacterium saccharolyticum*. In some embodiments, the polypeptide comprises an amino acid sequence having at least 60%, 65%, 70%, 75%, 80%, 85%, 90%, 95%, or 98% sequence identity to SEQ ID NO:349, and the one or more modifications are relative to SEQ ID NO:349. In some embodiments, the polypeptide has an improved D-fructose C4-epimerase activity and/or improved stability compared to the polypeptide of SEQ ID NO:349. In some embodiments, the polypeptide is derived from *Petrotoga mobilis*. In some embodiments, the polypeptide comprises an amino acid sequence having at least 60%, 65%, 70%, 75%, 80%, 85%, 90%, 95%, or 98% sequence identity to SEQ ID NO:350, and the one or more modifications are relative to SEQ ID NO:350. In some embodiments, the polypeptide has an improved D-fructose C4-epimerase activity and/or improved stability compared to the polypeptide of SEQ ID NO:350. In some embodiments, the polypeptide is derived from *Spirochaeta thermophila*.

In some embodiments, the polypeptide comprises an amino acid sequence having at least 60%, 65%, 70%, 75%, 80%, 85%, 90%, 95%, or 98% sequence identity to SEQ ID NO:351, and the one or more modifications are relative to SEQ ID NO:351. In some embodiments, the polypeptide has an improved D-fructose C4-epimerase activity and/or improved stability compared to the polypeptide of SEQ ID NO:351. In some embodiments, the polypeptide is derived from *Ignisphaera aggregans*. In some embodiments, the polypeptide comprises an amino acid sequence having at least 60%, 65%, 70%, 75%, 80%, 85%, 90%, 95%, or 98% sequence identity to SEQ ID NO:352, and the one or more modifications are relative to SEQ ID NO:352. In some embodiments, the polypeptide has an improved D-fructose C4-epimerase activity and/or improved stability compared to the polypeptide of SEQ ID NO:352. In some embodiments, the polypeptide is derived from *Thermotoga maritima*. In some embodiments, the polypeptide comprises an amino acid sequence having at least 60%, 65%, 70%, 75%, 80%, 85%, 90%, 95%, or 98% sequence identity to SEQ ID NO:353, and the one or more modifications are relative to SEQ ID NO:353. In some embodiments, the polypeptide has an improved D-fructose C4-epimerase activity and/or improved stability compared to the polypeptide of SEQ ID NO:353. In some embodiments, the polypeptide is derived from *Caldanaerobacter subterraneus*. In some embodiments, the polypeptide comprises an amino acid sequence having at least 60%, 65%, 70%, 75%, 80%, 85%, 90%, 95%, or 98% sequence identity to SEQ ID NO:354, and the one or more modifications are relative to SEQ ID NO:354. In some embodiments, the polypeptide has an improved D-fructose C4-epimerase activity and/or improved stability compared to the polypeptide of SEQ ID NO:354. In some embodiments, the polypeptide is derived from *Mesotoga infera*. In some embodiments, the polypeptide comprises an amino acid sequence having at least 60%, 65%, 70%, 75%, 80%, 85%, 90%, 95%, or 98% sequence identity to SEQ ID NO:355, and the one or more modifications are relative to SEQ ID NO:355. In some embodiments, the polypeptide has an improved D-fructose C4-epimerase activity and/or improved stability compared to the polypeptide of SEQ ID NO:355. In some embodiments, the polypeptide is derived from *Thermosinus carboxydivorans*. In some embodiments, the polypeptide comprises an amino acid sequence having at least 60%, 65%, 70%, 75%, 80%, 85%, 90%, 95%, or 98% sequence identity to SEQ ID NO:356, and the one or more modifications are relative to SEQ ID NO:356. In some embodiments, the polypeptide has an improved D-fructose C4-epimerase activity and/or improved stability compared to the polypeptide of SEQ ID NO:356. In some embodiments, the polypeptide is derived from *Halanaerobium congolense*. In some embodiments, the polypeptide comprises an amino acid sequence having at least 60%, 65%, 70%, 75%, 80%, 85%, 90%, 95%, or 98% sequence identity to SEQ ID NO:357, and the one or more modifications are relative to SEQ ID NO:357. In some embodiments, the polypeptide has an improved D-fructose C4-epimerase activity and/or improved stability compared to the polypeptide of SEQ ID NO:357. In some embodiments, the polypeptide is derived from *Halanaerobium congolense*. In some embodiments, the polypeptide comprises an amino acid sequence having at least 60%, 65%, 70%, 75%, 80%, 85%, 90%, 95%, or 98% sequence identity to SEQ ID NO:358, and the one or more modifications are relative to SEQ ID NO:358. In some embodiments, the polypeptide has an improved D-fructose C4-epimerase activity and/or improved stability compared to the polypeptide of SEQ ID NO:358. In some embodiments, the polypeptide is derived from *Halanaerobium saccharolyticum*. In some embodiments, the polypeptide comprises an amino acid sequence having at least 60%, 65%, 70%, 75%, 80%, 85%, 90%, 95%, or 98% sequence identity to SEQ ID NO:359, and the one or more modifications are relative to SEQ ID NO:359. In some embodiments, the polypeptide has an improved D-fructose C4-epimerase activity and/or improved stability compared to the polypeptide of SEQ ID NO:359. In some embodiments, the polypeptide is derived from *Gracilibacillus halophilus*. In some embodiments, the polypeptide comprises an amino acid sequence having at least 60%, 65%, 70%, 75%, 80%, 85%, 90%, 95%, or 98% sequence identity to SEQ ID NO:360, and the one or more modifications are relative to SEQ ID NO:360. In some embodiments, the polypeptide has an improved D-fructose C4-epimerase activity and/or improved stability compared to the polypeptide of SEQ ID NO:360.

In some embodiments, the polypeptide is derived from *Caldanaerobacter subterraneus*. In some embodiments, the polypeptide comprises an amino acid sequence having at least 60%, 65%, 70%, 75%, 80%, 85%, 90%, 95%, or 98% sequence identity to SEQ ID NO:361, and the one or more modifications are relative to SEQ ID NO:361. In some embodiments, the polypeptide has an improved D-fructose C4-epimerase activity and/or improved stability compared to the polypeptide of SEQ ID NO:361. In some embodiments, the polypeptide is derived from *Litorilinea aerophila*. In some embodiments, the polypeptide comprises an amino acid sequence having at least 60%, 65%, 70%, 75%, 80%, 85%, 90%, 95%, or 98% sequence identity to SEQ ID NO:362, and the one or more modifications are relative to SEQ ID NO:362. In some embodiments, the polypeptide has an improved D-fructose C4-epimerase activity and/or improved stability compared to the polypeptide of SEQ ID NO:362. In some embodiments, the polypeptide is derived from *Caldanaerobacter subterraneus*. In some embodiments, the polypeptide comprises an amino acid sequence having at least 60%, 65%, 70%, 75%, 80%, 85%, 90%, 95%, or 98% sequence identity to SEQ ID NO:363, and the one or more modifications are relative to SEQ ID NO:363. In some embodiments, the polypeptide has an improved D-fructose C4-epimerase activity and/or improved stability compared to the polypeptide of SEQ ID NO:363. In some embodiments, the polypeptide is derived from *Caldanaerobacter subterraneus*. In some embodiments, the polypeptide comprises an amino acid sequence having at least 60%, 65%, 70%, 75%, 80%, 85%, 90%, 95%, or 98% sequence identity to SEQ ID NO:364, and the one or more modifications are relative to SEQ ID NO:364. In some embodiments, the polypeptide has an improved D-fructose C4-epimerase activity and/or improved stability compared to the polypeptide of SEQ ID NO:364. In some embodiments, the polypeptide is derived from *Caldicoprobacter faecalis*. In some embodiments, the polypeptide comprises an amino acid sequence having at least 60%, 65%, 70%, 75%, 80%, 85%, 90%, 95%, or 98% sequence identity to SEQ ID NO:365, and the one or more modifications are relative to SEQ ID NO:365. In some embodiments, the polypeptide has an improved D-fructose C4-epimerase activity and/or improved stability compared to the polypeptide of SEQ ID NO:365. In some embodiments, the polypeptide is derived from *Thermoanaerobacter uzonensis*. In some embodiments, the polypeptide comprises an amino acid sequence having at least 60%, 65%, 70%, 75%, 80%, 85%, 90%, 95%, or 98% sequence identity to SEQ ID NO:366, and the one or more modifications are relative to SEQ ID NO:366. In some embodiments, the polypeptide has an improved D-fructose C4-epimerase activity and/or improved stability compared to the polypeptide of SEQ ID NO:366. In some embodiments, the polypeptide is derived from *Lactobacillus ingluviei*. In some embodiments, the polypeptide comprises an amino acid sequence having at least 60%, 65%, 70%, 75%, 80%, 85%, 90%, 95%, or 98% sequence identity to SEQ ID NO:367, and the one or more modifications are relative to SEQ ID NO:367. In some embodiments, the polypeptide has an improved D-fructose C4-epimerase activity and/or improved stability compared to the polypeptide of SEQ ID NO:367. In some embodiments, the polypeptide is derived from *Petrotoga mexicana*. In some embodiments, the polypeptide comprises an amino acid sequence having at least 60%, 65%, 70%, 75%, 80%, 85%, 90%, 95%, or 98% sequence identity to SEQ ID NO:368, and the one or more modifications are relative to SEQ ID NO:368. In some embodiments, the polypeptide has an improved D-fructose C4-epimerase activity and/or improved stability compared to the polypeptide of SEQ ID NO:368. In some embodiments, the polypeptide is derived from *Defluviitoga tunisiensis*. In some embodiments, the polypeptide comprises an amino acid sequence having at least 60%, 65%, 70%, 75%, 80%, 85%, 90%, 95%, or 98% sequence identity to SEQ ID NO:369, and the one or more modifications are relative to SEQ ID NO:369. In some embodiments, the polypeptide has an improved D-fructose C4-epimerase activity and/or improved stability compared to the polypeptide of SEQ ID NO:369. In some embodiments, the polypeptide is derived from *Petrotoga miotherma*. In some embodiments, the polypeptide comprises an amino acid sequence having at least 60%, 65%, 70%, 75%, 80%, 85%, 90%, 95%, or 98% sequence identity to SEQ ID NO:370, and the one or more modifications are relative to SEQ ID NO:370. In some embodiments, the polypeptide has an improved D-fructose C4-epimerase activity and/or improved stability compared to the polypeptide of SEQ ID NO:370. In some embodiments, the polypeptide is derived from *Petrotoga olearia*. In some embodiments, the polypeptide comprises an amino acid sequence having at least 60%, 65%, 70%, 75%, 80%, 85%, 90%, 95%, or 98% sequence identity to SEQ ID NO:371, and the one or more modifications are relative to SEQ ID NO:371. In some embodiments, the polypeptide has an improved D-fructose C4-epimerase activity and/or improved stability compared to the polypeptide of SEQ ID NO:371. In some embodiments, the polypeptide is derived from *Thermophagus xiamenensis*. In some embodiments, the polypeptide comprises an amino acid sequence having at least 60%, 65%, 70%, 75%, 80%, 85%, 90%, 95%, or 98% sequence identity to SEQ ID NO:372, and the one or more modifications are relative to SEQ ID NO:372. In some embodiments, the polypeptide has an improved D-fructose C4-epimerase activity and/or improved stability compared to the polypeptide of SEQ ID NO:372. In some embodiments, the polypeptide is derived from *Treponema caldarium*. In some embodiments, the polypeptide comprises an amino acid sequence having at least 60%, 65%, 70%, 75%, 80%, 85%, 90%, 95%, or 98% sequence identity to SEQ ID NO:373, and the one or more modifications are relative to SEQ ID NO:373. In some embodiments, the polypeptide has an improved D-fructose C4-epimerase activity and/or improved stability compared to the polypeptide of SEQ ID NO:373. In some embodiments, the polypeptide is derived from *Thermofilum uzonense*.

TABLE 1

Modified Polypeptides

| SEQ NO. | Plasmid ID | Parent Wild Type SEQ ID NO. | Mutation Position (correspond to SEQ ID NO.: 2) | Mutation Position (correspond to SEQ ID NO.: 6) |
|---|---|---|---|---|
| 24 | pA07199 | 2 | C28A | C17A |
| 25 | pA07200 | 2 | E52A | E41A |
| 26 | pA07201 | 2 | E52Q | E41Q |
| 27 | pA07202 | 2 | Y64A | Y53A |

TABLE 1-continued

Modified Polypeptides

| SEQ NO. | Plasmid ID | Parent Wild Type SEQ ID NO. | Mutation Position (correspond to SEQ ID NO.: 2) | Mutation Position (correspond to SEQ ID NO.: 6) |
|---|---|---|---|---|
| 28 | pA07203 | 2 | Y64F | Y53F |
| 29 | pA07204 | 2 | D95A | D84A |
| 30 | pA07205 | 2 | D95N | D84N |
| 31 | pA07206 | 2 | H96A | H85A |
| 32 | pA07207 | 2 | H130A | H119A |
| 33 | pA07208 | 2 | D132A | D121A |
| 34 | pA07209 | 2 | D132N | D121N |
| 35 | pA07210 | 2 | E178A | D167A |
| 36 | pA07211 | 2 | E178Q | D167Q |
| 37 | pA07212 | 2 | E263A | E245A |
| 38 | pA07213 | 2 | E263Q | E245Q |
| 39 | pA07214 | 2 | H265A | H247A |
| 40 | pA07215 | 2 | D268A | D250A |
| 41 | pA07216 | 2 | D268N | D250N |
| 42 | pA07217 | 2 | G289A | G271A |
| 43 | pA07218 | 2 | G289D | G271D |
| 44 | pA07219 | 2 | Y361A | Y340A |
| 45 | pA07220 | 2 | Y361F | Y340F |

TABLE 2

Modified Polypeptides

| SEQ NO. | Plasmid ID | Parent Wild Type SEQ ID NO. | Mutation Position (correspond to SEQ ID NO.: 2) |
|---|---|---|---|
| 46 | pA12584 | 6 | E75P, S96A, P97E, S113A, P160A, A188T, I189L, S191V, Y195A, N197K, V199L, G232E, L234M, G246A, A253D, N259A, N333S, S374Q |
| 47 | pA12585 | 6 | P97E, S113A, Y135L, R143V, E147K, V182P, S191Y, V199I, G232E, G246A, G281A, L328F, S403A |
| 48 | pA12586 | 6 | K72L, S96A, P97E, S113A, R143A, T152A, P160A, A188M, S191T, G232K, M349K |
| 49 | pA12587 | 6 | S96A, P97E, S113A, R143V, S191T, G232D, A253S, S374Q, M383L |
| 50 | pA12588 | 6 | S21P, E75P, S96E, P97E, S113A, I189L, S191I, G232E, I233L, G281A, M349K |
| 51 | pA12589 | 6 | S21P, S96A, G232E, M349K, V350A |
| 52 | pA12590 | 6 | S96A, P97E, V182P, S191T, G232E, S286A, R325E |
| 53 | pA12591 | 6 | S96A, P97E, S113A, P160E, V182P, S191I, D198K, G246A |
| 54 | pA12592 | 6 | E75P, P97E, V182P, N197K, G246A, A253S, G281A, S286V, M349K, Y372P, S403Y |
| 55 | pA12593 | 6 | E75P, S113A, F146C, S190D, Y344H, Y372P |
| 56 | pA12594 | 6 | E147R, V182P, S191L, G281A, S374Q |
| 57 | pA12595 | 6 | S21P, P97E, Y135L, E345P |
| 58 | pA12596 | 6 | I202A, Y372P |
| 59 | pA12597 | 6 | E75P, P97E, Y135P, S191L, N197E |
| 60 | pA12598 | 6 | S113A, N333S |
| 61 | pA12599 | 6 | R143A, V182P, Y344H, E345P |
| 62 | pA12600 | 6 | S54T, S96A, R143A, A188M, S191V, G208A, G232E, E240T, A253S, R266V, S286A, R325E, I330L, E345P, F376R |
| 63 | pA12601 | 6 | S54T, S96A, P97E, N101E, S113A, R143A, G232E, G246A, G281A, E295P, R296E, F358L, E360D, M383L |
| 64 | pA12602 | 6 | K34R, S54T, S96A, S113A, A188M, N197K, G246A, N287D, V350A |
| 65 | pA12603 | 6 | S21P, S54T, S96A, S113A, R143A, S191I, M349R |
| 66 | pA12604 | 6 | K34R, P97E, S113A, G232E |
| 67 | pA12605 | 6 | S54T, E75P, S96A, P97E, S113A, L126C, S127A, R143V, V182P, A188T, S191T, N197K, V199H, G208A, G232E, G246C, A253S, R266V, G281A, N287D, E345P, V350A, E360D, V362I, F376R |
| 68 | pA12606 | 6 | S54T, E75P, S96A, S113A, E140I, E147R, A188M, S191T, N259W, E360D, S374Q, N385P |
| 69 | pA12607 | 6 | S21P, S54T, S96A, P97E, V182P, G208A, E240T, S374C |
| 70 | pA12608 | 6 | S21P, S27A, S54T, K78R, P97E, T98E, N101E, S113A, L126C, S127A, E147R, V182P, A188T, S191T, N197E, V199H, I202M, I215V, Y219H, G232D, E240T, A273W, G281A, Y344H, E345P, V350A, D363P, S374C |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 71 | pA12609 | 6 | S27A, K34D, Y37P, S54T, E75P, S113A, L126C, S127A, F146C, Y219H, N259W, R266V, N333S, E345P, V350A, D363P |
| 72 | pA12610 | 6 | S21P, S113A, S127A, E151R, A188T, G232D, E240T, Y344H, V350A, F358L, F366L |
| 73 | pA12611 | 6 | S21P, Y37P, T98E, F146C, A188T, Y219H, N259W, D363P |
| 74 | pA12612 | 6 | Y22W, S54T, L126C, E151R, V182P, A188T, Y219H, G232E, E345P, V350A, F358L |
| 75 | pA12613 | 6 | P97E, N101E, S113A, S127A, V199H, Y219H, E240T, N259W, Y344H |
| 76 | pA12614 | 6 | S27A, S54T, E75P, T98E, N101E, S113A, A188T, E240T, E297G, V350A |
| 77 | pA12615 | 6 | Y14F, P97E, F110Y, Y115F, Y135M, R143A, E147K, S191Y, G246A, G281A, L328F, M349K, S403A |
| 78 | pA12616 | 6 | P97E, S113A, V182P, A188F, G232E, V237L, A253S, M349T, M383L |
| 79 | pA12617 | 6 | S96A, P97E, S113A, E147K, P160A, V182A, S191I, G232D, G246A, S286A, R325E, M349K |
| 80 | pA12618 | 6 | S21P, E75P, R143A, I148V, S191I, V244L, E345P |
| 81 | pA12619 | 6 | S54T, K72L, P97E, A188M, S191I, D198K, G232E, R325E, S403A |
| 82 | pA12620 | 6 | S19N, K72V, S96A, P97E, S190D, S191T, N197K, G232E, G246A, G281A, Y372P, S403Y |
| 83 | pA12621 | 6 | S21K, E75P, P97E, S113A, R143V, S191T, V199I, V208A, G232E, V244L, G246A, N259W, G281A, S286A, E345P, Y372P, S374Q |
| 84 | pA12622 | 6 | S27A, E75P, Y135L, E147R, V182P, S190E, S191T, E240T, Y344H, M349K, S374Q |
| 85 | pA12623 | 6 | S21P, S27A, P97E, S113A, Y135T, L192F, Y219D, G281A, S286A, Y344H, E345P, F376E |
| 86 | pA12624 | 6 | S27A, E75P, S96A, G232D, S286A, E345P, Y372P |
| 87 | pA12625 | 6 | S27A, N101E, S113A, Y135P, S187E, S190E, Y344H |
| 88 | pA12626 | 6 | S96A, Y135L, E151R, V182P, S190D, G232E, K365R |
| 89 | pA12627 | 6 | S27A, E75P, S187R, G281A |
| 90 | pA12628 | 6 | S27A, S54T, S96A, F146C, V182P, Y344H, V350A, S403A |
| 91 | pA12629 | 6 | S21P, Y22W, S54T, E75P, S113A, V182P, N197E, E240T, G246V, S286A, R325E, I330L, Y344H, E345P, F376R |
| 92 | pA12630 | 6 | S21P, E75P, S96A, N101E, S127A, A188T, S191T, N197E, V199H, N201R, G208A, G232E, E240T, G246C, S286A, N287D, R296E, N333S, M349R, S374C |
| 93 | pA12631 | 6 | S27A, S113A, E140I, R143A, V182P, A188M, S191T, G232E, L242W, G246A, A253P, N259W, G281A, R325E, N333A, V350A, E360D, R379C, N385P |
| 94 | pA12632 | 6 | E75P, S96A, P97E, S127A, R143V, V182P, S191T, V199C, V237L, Y344H, M349A, F358L |
| 95 | pA12633 | 6 | S21P, S27A, P97E, S113A, S127A, T152A, A188M, S191V, G232E, R266V, A273W, S286A, N287D, N333A, E345P, M349K, V362I |
| 96 | pA12634 | 6 | S54T, E75P, S96A, P97E, A188T, L213M, G232E, Y344H, S374C |
| 97 | pA12635 | 6 | S54T, P97E, S127A, R143A, E345P, M349K, V350A |
| 98 | pA12636 | 6 | Y22W, K34D, Y37P, S54T, E75P, S113A, F146C, A188T, G232D, R266A, S286A, R296E, Y344H, E345P, K393H |
| 99 | pA12637 | 6 | S21P, Y22W, S27A, D36T, S54T, E75P, P97E, T98E, S127A, E147R, S191L, N197E, V199H, G232E, D241P, Y255E, N287D, Y344H, V350A, K365T, S374C |
| 100 | pA12638 | 6 | S21P, S27A, E75P, P97E, N101E, S113A, E147K, V182P, A188T, S190E, Y219H, Y255D, G281A, E343N, Y344H, V350A, E360D, K393H |
| 101 | pA12639 | 6 | Y22W, D36S, E75P, P97D, N101E, S113A, L126C, S127A, V182P, N197E, Y219H, D241P, A253S, Y255D, S286A, R296E, E343N, E345P, K365T, F376R |
| 102 | pA12640 | 6 | S54T, K62R, P97E, S113A, G232E, E240T, N259W, S286A, E297G, F376H |
| 103 | pA12641 | 6 | V13I, S21P, S27A, S54T, E75P, P97E, T98E, L126C, F146C, E147R, A188T, S190E, I202A, D241P, N259W, G281A, R296E, R303E, W331H, E345P, M349A, V350A, E360D, S374A, F376H |
| 104 | pA12642 | 6 | S27A, S96A, T98E, N101E, L126C, Y219H, E240T, A253T, R296Y, Y344H, E345P, M349A, F366L |
| 105 | pA12643 | 6 | S27A, G35D, K72L, E75P, P97E, F110Y, S113A, Y135M, E147K, S191L, N197K, G232E, G281A, L284K, I292L, L328F, M349K, Y372P, F376K |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 106 | pA12644 | 6 | P97E, Y135K, R143V, G232D, V237L, S286A, D290K, Y344H, M349T, M383L |
| 107 | pA12645 | 6 | S27A, K72L, E75P, S191V, L192F, N197K, V199L, I211V, G232E, S286A, S374Q |
| 108 | pA12646 | 6 | S21P, S27A, S54T, K72V, K78R, P97E, S190D, S191I, D198K, S286A, R325E, M349K |
| 109 | pA12647 | 6 | S27A, S113A, Y135L, A188M, S190D, S191T, N197E, R325E, F376Q |
| 110 | pA12648 | 6 | S27A, N101E, S113A, Y135L, E147K, I148V, L192F, N197K, E240T, A253D, Y255K, N259D, G281A, S286A, D290K, E345P, M349C, K365R, S374Q |
| 111 | pA12649 | 6 | S21P, S27A, S54T, E75P, P97E, N101E, Y135L, S187E, S190E, S191Y, N197E, V199L, G232D, A253D, R296D, Y344H, E345P, K365R |
| 112 | pA12650 | 6 | S21E, S54T, S96A, D105E, S113A, Y135L, V182P, S190E, S191A, E240T, A253T, S286A, K365R |
| 113 | pA12651 | 6 | S21E, S54T, E75P, N101E, S113A, Y135M, E147K, S190E, G232E, Y344H, M349K, K365R, S403A |
| 114 | pA12652 | 6 | S54T, E75P, P97E, N101E, S113A, Y135T, I148V, S187E, S190E, L192F, Y219D, G232D, L234A, S286A, E297K, E327R, V350A, K353R |
| 115 | pA12653 | 6 | S27A, S54T, E75P, P97E, T98E, N101A, S113A, S127A, S191V, N197K, V199L, L213M, G232E, G246A, N259W, S286A, N287D, K321H, N333S, Y344H, E345P, M349A, V350A |
| 116 | pA12654 | 6 | S21P, S27C, S54T, E75P, T98E, S113A, S127A, V182P, A188F, S191V, G232E, A253S, Y255E, S286A, D290K, E291D, N333S, Y344H, V350A, F358L, V362I, F366L, S374T |
| 117 | pA12655 | 6 | S21P, G35D, S54T, P97E, Y135Q, R143A, A188T, N197K, G232E, G246A, G281A, N287D, E295P, L328F, N333A, M349A, Y372P |
| 118 | pA12656 | 6 | S21P, E75P, P97E, T98E, N101A, R143V, V182P, G208A, E240T, G246V, A253S, R266V, S286A, K321H, R325D, Y344H, F366L |
| 119 | pA12657 | 6 | Y22W, S27A, S54T, E75P, S96A, P97E, N101A, S113A, S127A, R143A, G232E, E240T, V244L, S286D, M349R, V350A |
| 120 | pA12658 | 6 | S21P, D36S, S54T, N63R, E75P, D93H, P97D, N101E, Y115F, L126C, S127A, Y135N, E147R, V182P, S187R, A188T, V199H, Y219H, G246A, Y255E, N259W, R266A, G281A, N287D, K324D, W331H, N333S, Y344H, M349A, E360D, M383L, K393H, S403A |
| 121 | pA12659 | 6 | Y22W, S27A, K62R, N63R, S96A, P97E, T98E, D105E, S113A, L126C, S127A, E151R, V182P, S187K, S190E, S191A, N197A, G232E, E240T, Y255D, S286A, R296Y, E297R, R303E, K324D, E343N, E345P, M349A, V350A, F358L, F366L |
| 122 | pA12660 | 6 | V13I, S21P, K34D, Y37P, N63R, M66Y, E75P, P97D, T98E, L126C, V179I, S190E, S191L, L192F, N197K, Y219H, G232D, N259W, R266A, E291D, R303E, K324D, N333S, Y344H, V350A, D363P, M383L, K393H |
| 123 | pA12661 | 6 | S21P, Y22W, S27A, S54T, E75P, P97E, R143A, E144R, A188T, S191A, V199H, Y219H, V230A, N259W, S286A, N287D, K324E, E327R, W331H, Y344H, E345P, M349E, K353R, E360D, I364W, F376H |
| 124 | pA12662 | 6 | S21P, Y22W, Y37P, S54T, M66Y, D77N, P97E, S127A, A188T, S190E, S191A, Y219H, G232E, E240T, E262Q, R266A, S286A, R296Y, N333S, Y344H, E345P, M349A, V350A, D363P, K365T, S403A |
| 125 | pA12663 | 6 | S21P, S54T, S96A, P97E, N101K, S113A, Y135K, R143V, R154Q, V182K, A188F, S191T, N197D, G232E, V237L, A253D, Y255Q, N259R, V282I, S286A, D290Q, I292L, K302L, Y344H, M349K, S374Q, M383L |
| 126 | pA12664 | 6 | Y14F, S21K, S27A, K34M, G35H, K72L, E75P, S96A, F126C, P160A, S187T, Y195A, N197K, V199L, N201K, Y255K, A256L, G281A, K302L, Y344H, S374Q |
| 127 | pA12665 | 6 | S27A, G35D, S54T, E75P, S96A, Y115F, E147K, I148V, T152A, P160A, A188M, S190E, S191V, V199I, M349K |
| 128 | pA12666 | 6 | K34M, Y37P, S54T, M66F, E75P, E76P, S96A, I148V, T152A, V182P, S190D, S191Y, L192F, N197K, I202A, D241G, A253D, N259E, S286A, R296D, E297K, K324E, E327R, N333S, Y344H, E345P, V350A, Y372P |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 129 | pA12667 | 6 | S27A, S54T, M66F, E75P, E76P, P97E, D105E, S113A, Y135D, T142E, E147K, V179I, S187R, A188F, S190E, G232P, E240T, A253D, Y255Q, G281A, S286A, D290N, K324E, E327R, L334Y, E345P, M349K |
| 130 | pA12668 | 6 | M66F, S96A, T98Q, N101E, D105E, Y135P, R154Q, V182P, D184E, S187N, A188M, S190E, L192F, N197D, S218G, G232D, E240T, A253S, Y255K, D290N, E297K, E327R, E345P, M349A, K365R |
| 131 | pA12669 | 6 | S15A, S21P, G35D, S54T, E75P, S96A, T98E, N101A, S113A, K131A, V182P, S191T, G232E, E240T, G246A, N259W, R266V, G281A, N287D, D290K, K321T, K324D, M349K, E360D, V362I, S374A, F376H, R379C, N385P, S403A |
| 132 | pA12670 | 6 | S21P, K34Y, S54T, N63R, K78R, S96A, P97E, N101A, S113A, E147K, V182P, S190E, S191V, N197E, V199H, I202A, G208A, G232E, G246C, Y255E, G281A, N287D, D290K, E297H, K324D, M349A, S374C, R397K |
| 133 | pA12671 | 6 | S21P, S27A, K62R, E75P, P97E, S113A, S127A, D129E, R143A, V179I, S191T, V199H, N201R, Y219H, E240T, G246V, A253P, Y255E, R266V, N287D, R296E, M349A, N352E, Y372P, D373A, S374C |
| 134 | pA12672 | 6 | Y22W, K62R, N63R, M66Y, K67Q, E75P, D93H, S96A, N101A, F110Y, Y115F, L126C, D128G, R143A, E144R, I148V, E151R, S187K, S190E, V199H, I202A, I215V, G232E, D241P, R266A, G281A, S286A, N287D, D290K, E297H, R303C, K321R, K324E, R325N, E327R, N333S, Y344H, E345P, S374C, F376H, D377A |
| 135 | pA12673 | 6 | V13I, S21P, Y22W, S27A, F30H, K34D, S54T, N63R, E75P, D93H, S96A, P97E, T98E, N101E, D105E, F110Y, Y115F, K131A, E136D, R143A, F146C, E147R, I148V, S187K, L192F, N197Q, N201Q, D204N, G232Q, D241P, A253N, Y255D, R280N, S286A, N287D, R296E, E297Q, R325Q, E327R, L328W, N333S, E343N, V350A, N352E, D363P, S374A, M383L |
| 136 | pA12674 | 6 | V13I, I16V, S21P, Y22W, S27A, D36S, M66Y, D77N, D93H, T98E, N101A, L126C, S127A, D128G, K131A, Y135Q, F146C, V182P, S187K, L192F, V199H, P200G, V230A, G232E, E240T, Y255D, G281A, E297Q, R303E, R325N, W331H, N333S, E343N, Y344H, N352E, V362I, I364W, F376R, S403H |
| 137 | pA14284 | 6 | K5A, K10N, K116R, K238S, K302Q, K318D, K321D, K324D, K348R, K353R, K365R, K382R |
| 138 | pA14285 | 6 | K11L, K32L, K34M, K67S, K70Q, K193Q, K318D, K321D, K324E, K348L, K353L |
| 139 | pA14286 | 6 | K10N, K34E, K70R, K131E, K137E, K155E, K321D, K324D, K348R, K382R, K384D |
| 140 | pA14287 | 6 | K5F, K10M, K11L, K62V, K70R, K116I, K131E, K194A, K321D, K324D, K353L, K384S |
| 141 | pA14288 | 6 | K11L, K70Q, K78L, K137L, K238S, K321D, K3655 |
| 142 | pA14289 | 6 | K10N, K70R, K104R, K155E, K193A, K238S, K321D, K353L, K382R, K384T |
| 143 | pA14290 | 6 | K5L, C17G, K34M, K72L, K78L, K102Y, K193Q, K321D, K324E |
| 144 | pA14291 | 6 | K10N, C17T, K34T, K62R, K72L, K116H, C122T, K131Q, K137T, K193E, K194E, K321D, K324D, K382R |
| 145 | pA14292 | 6 | C17T, K34Q, K62R, K70R, K72V, K131Q, K155R, K194T, K229R, K238S, K365R |
| 146 | pA14293 | 6 | K10R, K131Q, K229T, K321D, K348R, K353R, K382R |
| 147 | pA14294 | 6 | K67T, K78L, K102Y, K131E, K365R |
| 148 | pA14295 | 6 | K10N, K11L, C17T, K32M, K34L, K137L, K384S |
| 149 | pA14296 | 6 | K10N, C17T, K32M, K34L, K70R, K102L, K131Y, K137L, K193Q, K221V, K229R, K238S, K321D, K382R, K393H |
| 150 | pA14297 | 6 | K5W, K10R, K32M, K67Q, K70R, K78M, K131Q, K193I, K348L |
| 151 | pA14298 | 6 | K70R, K104N, K117L, K221R, K229T, K348R, K353Q, K384D |
| 152 | pA14299 | 6 | K11Q, K34Q, K62R, K67T, K104Q, K131E, K137T, K318D, K321D, K353R, K384E |
| 153 | pA14300 | 6 | K78L, K229R, K302I, K365S |
| 154 | pA14301 | 6 | K5M, K10L, K67T, K70R, K72L, K131Q, K137L, K221R, K318D, K353W, K365H, K384D, K392R, K396M |
| 155 | pA14302 | 6 | C17T, K67T, K70R, K102T, K104N, K155N, K318D, K321D |
| 156 | pA14303 | 6 | K104R, K131R, K193E, K238S, K348L |
| 157 | pA14304 | 6 | K5H, K67T, K78L, K117W, C122A, K155N, K302L, K318D, K353L, K384S, K396L |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 158 | pA14305 | 6 | K62R, K67T, K104N, K131Q, K137Q, K221R, K238S, K324S, K382R |
| 159 | pA14306 | 6 | K5L, K10N, K11Q, K62R, K67T, K70R, K131Q, K137Q, K193E, K194E, K221R, K302R, K321D, K324D, K348R, K382R, K384D |
| 160 | pA14307 | 6 | K10N, C17T, K70R, K104R, K122A, K131E, K137E, K155E, K193E, K229R, K321D, K324D, K348R, K353R |
| 161 | pA14308 | 6 | K5H, K11V, K72L, K116T, C122T, K324E, K382L, K384E, K393Y |
| 162 | pA14309 | 6 | K5F, K10N, K11Q, C17A, K32Q, K34Q, K67T, K72L, K137T, K229R, K238S, K318D, K321D, K324D, K348R, K353Q |
| 163 | pA14310 | 6 | K5F, K34Q, K72T, K78Q, K137T, K155N, K221T, K238S, K302R, K324D, K382R |
| 164 | pA14311 | 6 | K62V, K70R, K78L, K104Q, K116I, K155N, K193K, K221V, K229R, K321D, K324D, K348L, K382R, K393H |
| 165 | pA14312 | 6 | K5W, K10R, C17T, K62R, K67T, K70R, K72L, K78R, K104R, K116R, K137E, K193R, K194T, K238S, K302Q, K321D, K348R, K353R, K365R, K384E |
| 166 | pA14313 | 6 | K10L, K11Y, K34T, K62V, K67T, K102Y, K116Y, K131Q, K137L, K155Y, K193A, K194A, K221R, K238S, K318D, K353W, K382R, K384L |
| 167 | pA14314 | 6 | K5A, K11Q, C17T, K32Q, K34E, K67T, K70R, K72L, K102R, K104R, K131E, K155E, K229R, K238S, K302Q, K318D, K321D, K324D, K353R, K384T |
| 168 | pA14315 | 6 | K5A, K10N, K67T, K70R, K78Q, K102R, K131E, K137E, K155E, K193E, K194R, K229R, K321D, K348R, K353R, K365R |
| 169 | pA14316 | 6 | K5F, K10N, K11Q, C17I, K34Q, K62R, K67T, K70R, K104Q, C122T, K131E, K221T, K238S, K269I, K318D, K321D, K324D, K348R, K353Q, K382R, K384E |
| 170 | pA14317 | 6 | K5A, K32I, K62Y, K67T, K72L, K116L, K193A, K194T, K221I, K229R, K238S, K302I, K318D, K321D, K353L, K382R, K384T |
| 171 | pA14318 | 6 | K70R, K78L, K102Y, K131E, K269L, K348V, K365R, K392M, K393L |
| 172 | pA14319 | 6 | K5F, K11Q, K32Q, K62R, K78Q, K116Q, K137T, K229R, K318D, K321D, K324D, K348R, K353Q, K384D |
| 173 | pA14320 | 6 | K5F, K10M, K34L, K67T, K70R, K78L, K104R, K131E, K193Q, K194R, K221V, K238W, K324D, K353W, K365S, K384S |
| 174 | pA14321 | 6 | K11Y, K34L, K70R, K221I, K229R, K238S, K318D, K324D, K348V, K365R, K393L |
| 175 | pA14322 | 6 | K32I, K62V, K104I, C122T, K137L, K194A, K238S, K318D, K353L, K365S, K384E, K392L |
| 176 | pA14323 | 6 | K11V, K32L, K34Y, K62V, K67R, K70Q, K78R, K102L, K116T, K131R, K155E, K194A, K221I, K318D, K321D, K348L, K365R, K382L |
| 177 | pA14324 | 6 | K32L, K34M, K67S, K78Q, K102L, K116T, K194S, K302I, K321D, K348L, K353L, K382L |
| 178 | pA14325 | 6 | K10L, K11Y, C17T, K62Y, K67T, K70R, K72L, K117M, C122V, K131Q, K137L, K155Y, K193A, K221R, K229T, K269V, K318D, K321D, K324D, K353W, K365H, K382R, K392L, K396M |
| 179 | pA14326 | 6 | K10N, K11V, C17G, K32L, K67S, K78L, K193E, K302I, K318D, K353L, K365R, K384T, K392L |
| 180 | pA14327 | 6 | K10N, K11L, K32L, K78Q, K104R, K116T, K131E, K194R, K318D, K321D, K348L, K353L, K365S, K382L, K384E |
| 181 | pA14328 | 6 | K5L, K72L, K78L, K137L, K155E, K238S, K302L, K321D, K365S, K393Y |
| 182 | pA14329 | 6 | K5M, K10L, K11L, C17T, K32M, K34L, K70R, K72L, K78L, K102L, K116I, K155N, K194S, K221V, K238S, K318D, K321D, K324D, K348L, K382R |
| 183 | pA14330 | 6 | K10N, K11L, K32M, K34L, K62V, K67T, K78L, K102L, K116I, K131Y, K137L, K155N, K193Q, K194R, K229R, K302L, K318D, K321D, K324D, K348L, K353W, K382R, K384S |
| 184 | pA14331 | 6 | C17G, K34M, K70Q, K104R, K131R, K302I, K348L, K365R, K384Q, K393Y |
| 185 | pA14332 | 6 | K5L, C17G, K34T, K67S, K72L, K78L, K269N, K321D, K382L, K393Y |
| 186 | pA14333 | 6 | K5W, K10V, K11Y, K32M, K34T, K62V, K67T, K70R, K78L, K102Y, K104F, K116Y, K131Q, K137L, K155Y, K193A, K194A, K221R, K229S, K238W, K302L, K318D, K321D, K324D, K348L, K353W, K365H, K382R, K384D |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 187 | pA14334 | 6 | K5W, K11Y, K32M, K34T, K70R, K72L, K78M, K102Y, K104F, K116Y, C122V, K131Q, K193A, K194A, K238W, K269L, K302L, K318D, K321D, K324D, K348L, K382R, K384D, K392L, K393Y |
| 188 | pA14335 | 6 | K5A, K10N, K11Q, C17L, K32Q, K34E, K67T, K70R, K72L, K78Q, K102R, K104R, K116R, K117W, C122T, K131E, K155E, K194R, K229R, K238S, K269L, K302R, K321D, K365R, K382R, K384D |
| 189 | pA14336 | 6 | K5L, K10A, C17G, K32L, K34Y, K70Q, K72L, K116T, K131R, K155E, K194A, K221I, K238S, K302I, K318D, K321D, K324E, K348L, K353L, K384Q, K396M |
| 190 | pA14337 | 6 | K10N, K11L, C17I, K32M, K34L, K62Y, K67T, K72T, K78L, K116L, K117W, C122A, K131E, K155N, K221V, K229R, K269I, K302M, K321D, K324D, K348L, K353W, K382R, K384R, K392L, K396R |
| 191 | pA14338 | 6 | K11Q, K34E, K62R, K72L, K104R, C122A, K137E, K193E, K221Q, K229R, K318D, K321D, K324D, K348R, K353R, K365R, K384D |
| 192 | pA14339 | 6 | K5A, K10L, K11Q, K32I, K62V, K70R, K72L, K78L, K102Y, K104R, K116L, K131E, K137L, K155E, K229R, K318D, K321D, K348V, K353L, K382R, K384T, K392R |
| 193 | pA14340 | 6 | K5M, K11Q, C17S, K34L, K62V, K67T, K70R, K72L, K102Y, K104Q, K131Y, K137L, K193Q, K221V, K229R, K238W, K302L, K318D, K321D, K353L, K365S, K384R, K392L, K393H, K396I |
| 194 | pA14341 | 6 | K5H, K10N, K32L, K34T, K67S, K70Q, K78L, K102L, K104R, K116T, K131E, K137L, K194R, K229R, K238S, K318D, K321D, K365R, K382L |
| 195 | pA14342 | 6 | K5F, K10L, K11L, K32M, K34L, K62V, K67T, K70R, K78L, K102Y, K104Q, K116I, K131E, K137L, K155N, K193Q, K194A, K221I, K229R, K238W, K302L, K318D, K321D, K324D, K348L, K353W, K365S, K382R, K384D |
| 196 | pA14343 | 6 | K5L, K11V, K32L, K34M, K62V, K67S, K70Q, K78L, K155R, K194A, K229R, K302L, K321D, K324E, K348L, K365R, K384Q, K393Y |
| 197 | pA14344 | 6 | K5W, K10N, K11Q, C17T, K34T, K62R, K67T, K72L, K102R, K131Q, K137Q, K155H, K194E, K221R, K229T, K302Q, K318D, K321D, K353R, K382R |
| 198 | pA14345 | 6 | K5L, K11L, K32I, K34T, K62V, K67S, K70Q, K72L, K116T, K131E, K137L, K155E, K193E, K229A, K324E, K348L, K353L, K382L, K384R, K392L, K393Y |
| 199 | pA14346 | 6 | K11L, K67S, K72L, K104I, C122T, K131R, K193E, K194A, K221I, K229A, K302L, K318D, K321D, K324E, K348L, K353L, K365S, K382L, K392L, K396M |
| 200 | pA14347 | 6 | K5H, K11V, C17G, K32I, K34T, K70Q, K72L, K78L, K104R, K117L, K131E, K155E, K194T, K221I, K229R, K269N, K321D, K348L, K353L, K365R, K382L, K393Y, K396I |
| 201 | pA14348 | 6 | K5F, K10M, K11L, C17I, K32M, K34L, K62V, K67T, K70R, K72L, K78L, K102L, K104Q, K116I, K117V, C122T, K131E, K137E, K155N, K193Q, K194A, K221V, K229R, K238S, K269I, K302L, K318D, K321D, K324D, K348L, K353L, K365S, K382R, K384R, K392L, K393H, K396M |
| 202 | pA14349 | 6 | K5W, K10N, K11Q, C17I, K32Q, K34T, K62R, K67T, K70R, K72L, K78R, K102R, K104R, K116H, K117V, C122V, K131Q, K137T, K155H, K193E, K194E, K221R, K229T, K238R, K269V, K302Q, K318D, K321D, K324D, K348R, K353R, K365H, K382R, K384D |
| 203 | pA14350 | 6 | K5A, K10N, K11Q, C17T, K32Q, K34E, K62R, K67T, K70R, K72L, K78Q, K102R, K104R, K116R, K131E, K137E, K155E, K193E, K194T, K221Q, K229R, K238S, K302Q, K318D, K321D, K324D, K348R, K353R, K365R, K382R, K384D |
| 204 | pA14351 | 6 | K5L, C17G, K32I, K34M, K62V, K72L, K78L, K102L, K116T, C122T, K131E, K137L, K155E, K193Q, K194R, K229R, K269N, K302I, K318D, K321D, K324E, K348L, K353L, K365S, K384R, K392L, K393Y |
| 205 | pA14352 | 6 | K5F, K10N, K11Q, K32Q, K34Q, K62R, K67T, K70R, K78Q, K102R, K104Q, K116R, K131E, K137T, K155N, K193Q, K194S, K221T, K229R, K238S, K302Q, K318D, K321D, K324D, K348R, K353R, K365S, K382R, K384E |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 206 | pA14353 | 6 | K5L, K10N, K11E, C17V, K32Q, K34H, K62R, K67Q, K70R, K72L, K78R, K102R, K104R, K116R, K131R, K137E, K155E, K193E, K194T, K221R, K229N, K238S, K302R, K318D, K321D, K324S, K348R, K353Q, K365R, K382N, K384Q |
| 207 | pA14354 | 6 | K5L, K10N, K11V, C17I, K32S, K34F, K62V, K67Q, K70R, K72I, K78M, K102L, K104F, K116W, K117V, C122A, K131R, K137E, K155E, K193A, K194A, K221I, K229Q, K238S, K269V, K302L, K318D, K321D, K324S, K348L, K353L, K365R, K382N, K384R, K392L, K393F, K396F |
| 208 | pA14355 | 6 | K5L, K10N, K11L, K32L, K34M, K62V, K67S, K70Q, K78L, K102Y, K104R, K116T, K131E, K137L, K155E, K193Q, K194R, K221I, K229R, K238S, K302I, K318D, K321D, K324E, K348L, K353L, K365S, K382L, K384E |
| 209 | pA14356 | 6 | K5L, K10A, K11L, K32I, K34T, K62V, K67S, K70Q, K78L, K102Y, K104I, K116T, K131E, K137L, K155E, K193E, K194A, K221I, K229A, K238S, K302L, K318D, K321D, K324E, K348L, K353L, K365S, K382L, K384E |
| 210 | pA14357 | 6 | K5W, K10R, K11R, K32Q, K34Q, K62R, K67T, K70R, K78Q, K102R, K104R, K116R, K131Q, K137E, K155D, K193R, K194T, K221R, K229T, K238S, K302Q, K318E, K321D, K324D, K348R, K353R, K365R, K382R, K384E |
| 211 | pA14358 | 6 | K5M, K10M, K11Q, C17S, K32M, K34L, K62V, K67T, K70R, K72L, K78M, K102L, K104R, K116I, K131Y, K137L, K155N, K193A, K194S, K221I, K229R, K238S, K302L, K318D, K321D, K324D, K348L, K353W, K365S, K382R, K384R, K392L, K393Y, K396M |
| 212 | pA14359 | 6 | K5F, K10L, K11L, C17T, K32M, K34L, K62Y, K67Q, K70R, K72L, K78R, K102Y, K104V, K116R, K131L, K137E, K155E, K193E, K194A, K221V, K229A, K238S, K302M, K318D, K321D, K324S, K348R, K353L, K365S, K382R, K384R, K392L, K393Y, K396I |
| 213 | pA14360 | 6 | K5L, K10N, K11Q, C17S, K32Q, K34R, K62R, K67T, K70R, K72L, K78R, K102R, K104R, K116Q, K117V, C122T, K131E, K137E, K155E, K193E, K194S, K221R, K229S, K238S, K269V, K302Q, K318D, K321D, K324S, K348R, K353R, K365S, K382R, K384Q |
| 214 | pA14361 | 6 | K5L, K10A, K11V, C17G, K32L, K34Y, K62V, K67R, K70Q, K72L, K78R, K102L, K104R, K116T, K131R, K137I, K155E, K193E, K194A, K221I, K229N, K238S, K302L, K318D, K321D, K324E, K348L, K353L, K365R, K382L, K384R, K392L, K393Y, K396I |
| 215 | pA14362 | 6 | K5A, K10N, K11V, C17G, K32I, K34T, K62V, K67S, K70Q, K72L, K78L, K102Y, K104R, K116T, K131E, K137L, K155E, K193E, K194R, K221I, K229S, K238S, K302I, K318D, K321D, K324E, K348L, K353L, K365R, K382L, K384T, K392L, K393Y, K396I |
| 216 | pA14363 | 6 | K5A, K10N, K11V, C17G, K32I, K34M, K62V, K67S, K70Q, K72L, K78R, K102Y, K104I, K116S, K117L, C122T, K131E, K137L, K155E, K193E, K194A, K221I, K229A, K238S, K269N, K302L, K318D, K321D, K324E, K348R, K353L, K365S, K382L, K384R, K392L, K393Y, K396I |
| 217 | pA14364 | 6 | K5L, K10R, K11V, C17G, K32I, K34M, K62V, K67S, K70Q, K72L, K78L, K102Y, K104R, K116T, K117L, C122T, K131R, K137L, K155R, K193I, K194A, K221I, K229R, K238S, K269N, K302L, K318D, K321D, K324E, K348L, K353L, K365R, K382L, K384R, K392L, K393Y, K396I |
| 218 | pA14365 | 6 | K5R, K10R, K11R, K32R, K34R, K62R, K67R, K70R, K78R, K102R, K104R, K116R, K131R, K137R, K155R, K193R, K194R, K221R, K229R, K238R, K302R, K318R, K321R, K324R, K348R, K353R, K365R, K382R, K384R |
| 219 | pA14366 | 6 | K5R, K10R, K11R, C17R, K32R, K34R, K62R, K67R, K70R, K72R, K78R, K102R, K104R, K116R, K131R, K137R, K155R, K193R, K194R, K221R, K229R, K238R, K302R, K318R, K321R, K324R, K348R, K353R, K365R, K382R, K384R, K392R, K393R, K396R |
| 220 | pA14367 | 6 | K5R, K10R, K11R, C17R, K32R, K34R, K62R, K67R, K70R, K72R, K78R, K102R, K104R, K116R, K117R, C122R, K131R, K137R, K155R, K193R, K194R, K221R, K229R, K238R, K269R, K302R, K318R, K321R, K324R, K348R, K353R, K365R, K382R, K384R, K392R, K393R, K396R |
| 221 | pA14368 | 6 | K102Y, K131Q, K221R, K318D, K321D |
| 222 | pA14369 | 6 | K102L, K131E, K221I, K318D, K321D |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 223 | pA14370 | 6 | K102R, K131E, K221T, K318D, K321D |
| 224 | pA14371 | 6 | C17T, K102R, K131Q, K221R, K269V, K318D, K321D |
| 225 | pA14372 | 6 | C17L, K102L, K131E, K221R, K269L, K318D, K321D |
| 226 | pA14373 | 6 | C17G, K102Y, K131E, K221I, K318D, K321D |
| 227 | pA14374 | 6 | C17S, K102L, K131E, K221V, K318D, K321D |
| 228 | pA14375 | 6 | C17T, K102R, K131E, K221Q, K318D, K321D |
| 229 | pA14376 | 6 | C17G, K102L, K131E, K221Q, K269N, K318D, K321D |
| 230 | pA14377 | 6 | C17G, K269N |
| 231 | pA14378 | 6 | Y53F, D167A, Y340A |
| 232 | pA15875 | 6 | L3E, S4R, K5R, D6E, Y7N, L8G, R9Q, K10R, K11E, S21E, E25R, E29R, K32R, K34R, G35H, Y37R, Q49H, F50R, K62R, N63R, F64E, M66E, K67R, K70R, K72E, E75D, D77R, K78R, E94R, S96E, T98E, K102E, K104R, D105Q, K116D, D129E, K131E, P134D, E136R, K137E, R141Q, E144Q, I148E, E151R, T152R, A153R, R154T, K155E, Y156R, N157D, F158R, S187R, S190E, S191Y, K193E, K194R, N197P, S218T, Y219R, K221R, E224Q, D228E, K229E, G232R, K238R, E240T, N287P, D290R, E297R, S299Q, N300D, K302R, K318D, K321D, D322T, K324D, R325E, L326H, E327R, L328E, W331R, E343D, E345P, K348R, M349E, N352R, K353R, I364P, K365E, Y368R, Q369E, D373R, F376E, D377R, E380D, K382E, K384R, K392E, K393E, K396R, R397Q, S403R, N407D, L408R |
| 233 | pA15876 | 6 | L3E, S4R, K5R, D6R, Y7H, L8G, R9E, K10E, K11R, S21E, E25R, K32R, E33Q, K34R, D36R, Y37D, F50H, N63R, K67E, K70R, K72E, E75D, D77R, K78R, I80R, E94R, S96E, T98E, N101Q, K102E, K104R, D105E, K116R, Y135Q, K137E, E140Q, I148V, E151R, T152R, A153R, R154E, K155E, N157E, F158E, Q159E, S187R, S190E, S191H, K193E, K194E, N197P, W203R, S218T, Y219R, K221R, E224Q, E240T, E262R, N287E, D290R, E297R, S299Q, N300D, K302R, K318D, K321E, D322T, K324D, R325Q, E327R, W331R, E343D, E345P, K348R, M349E, N352R, K353R, I364E, K365R, F366R, Q369E, D373E, F376Q, E380D, K382R, K384R, K392R, K393E, K396R, S403E, N407D, L408G |
| 234 | pA15877 | 6 | S4R, D6Q, Y7N, L8N, R9E, K10P, K11V, S21P, K32M, K34L, G35S, Q49F, F50Q, K62R, N63R, K67E, K70R, E71S, E75D, D77R, K78M, E94L, S96E, T98Q, N101E, K102Y, K104R, D105Q, K116Q, K131E, V132T, P134D, Y135W, E136R, K137E, E151R, A153S, R154P, K155E, Y156V, N157P, F158N, Q159T, P160I, S190E, S191T, K193E, K194R, N197E, W203R, G216N, D220R, K221T, K229Q, R231E, G232E, E235R, K238E, E240T, R258E, E262R, N287Q, D290R, E297H, N300D, K302R, D313P, K318D, K321D, K324R, R325Q, L328E, E345P, K348E, M349E, N352R, K353Q, I364E, K365R, E380D, K382N, K384D, N385T, S403A, N407Q |
| 235 | pA15878 | 6 | S4R, K5Q, D6R, Y7N, L8G, R9E, K10P, K11V, S21E, K32Q, K34S, G35N, D36T, Q49H, F50R, E59R, K62R, N63R, M66E, K67E, K70R, E71S, E75D, D77R, K78R, E94R, S96E, T98E, N101Q, K102E, K104R, D105E, K116R, D129Q, P130S, K131E, V132T, P134D, E136R, K137E, E140R, R141Q, E147R, I148E, R154T, K155T, Y156D, N157P, F158N, Q159E, P160T, V179R, S190E, S191E, K193E, K194R, N197P, P200D, W203R, G216T, Y219R, K221R, K229Q, G232E, K238R, E240T, N287R, D290R, E297H, K302E, R303E, E307R, K318N, K321E, K324D, R325Q, E327R, L328E, E343D, E345P, K348R, M349E, N352R, K353Q, I364E, K365R, Q369R, E380D, K382R, K384Q, S403R, N407E |
| 236 | pA15879 | 6 | S4R, K5H, D6Q, Y7N, L8N, R9E, K10P, K11V, S21P, K32Q, K34S, G35N, D36S, F50H, N63E, K67R, K70R, E71S, E75D, D77R, K78R, E94Q, S96E, T98E, N101Q, K102E, K104R, D105E, K116L, D129Q, K131E, V132T, P134D, E136R, K137E, E140R, R141H, E147Q, A153S, R154P, K155P, Y156R, N157P, F158N, P160T, S190E, S191A, K193E, K194R, N197E, W203R, G216N, D220R, K221E, K229Q, R231E, G232R, E235R, K238E, E240T, N287Q, D290R, E297H, K302Q, R303E, E307Q, D313P, K318D, K321D, K324R, R325Q, L328E, E343D, E345P, K348E, M349E, N352R, K353Q, I364E, K365R, Q369R, S403R, N407E |
| 237 | pA15880 | 6 | S4R, K5Q, D6R, Y7N, L8G, R9Q, K10R, K11W, S21E, E25R, E29R, E33Q, K34R, G35D, D36Q, Q49H, F50R, E59R, K62R, N63R, M66E, K67Q, K70R, K72E, E76P, D77R, K78R, E94R, S96E, T98E, N101E, K102E, K104R, D105E, K116E, P130S, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | K131E, V132T, P134D, E136R, K137E, E140R, E147R, I148E, R154T, K155T, Y156D, N157P, F158N, Q159R, P160T, V179R, S190E, S191Y, K193R, K194Q, N197Q, G216T, Y219R, D220R, K221R, K229Q, G232E, K238R, E240T, N287E, D290R, E297R, K302R, R303E, E307R, K321E, K324D, R325E, L328E, W331E, E343D, E345P, K348R, M349R, N352E, K353E, E356R, I364E, K365R, Q369R, D377H, E380D, K382R, K384R, K392E, K393Q, K396R, R397E, S403R, N407E |
| 238 | pA15881 | 6 | S4E, K5R, D6H, L8N, R9L, K10E, K11R, S21P, K32R, E33N, K34R, G35H, D36L, Y37P, Q49I, E59T, K62R, N63D, K67D, K70R, E71R, E75D, D77R, K78D, E94L, S96A, T98E, N101D, K102R, K104R, D105Q, K116R, D129Q, K131E, P134H, Y135W, E136D, K137E, R141L, E147R, I148V, T152V, R154Q, K155D, N157P, F158N, Q159L, P160L, V179I, S190E, S191A, K193R, K194R, P200L, G216R, K221R, E224M, K229R, G232E, K238R, E240V, D241P, E262Q, N287L, E297R, N300E, K302R, D313P, K318D, K321D, K324D, E327Y, L328W, W331L, E343D, E345P, K348R, M349T, N352E, K353E, E356R, G361P, D363P, I364L, K365E, F366H, Y368R, Q369D, F376E, E380D, K382R, K384E, S403A, N407D, L408T |
| 239 | pA15882 | 6 | L3E, S4R, K5R, D6E, L8G, R9Q, K10R, K11E, S21R, K32R, E33T, K34R, G35R, Y37R, Q49H, F50R, N63R, F64E, K67R, K70R, E75D, D77R, K78R, E94R, S96R, T98E, K102E, K104R, D105Q, K116R, D129E, Y135W, K137E, R141Q, E144Q, I148E, E151R, T152R, A153R, R154T, K155E, V161E, S187R, S190E, S191E, K194R, N197P, W203R, Y219R, I292Q, S299Q, K318D, K321D, D322T, K324D, K326H, E327R, L328E, M349R, N352E, K353E, E356R, I364P, K365E, Y368R, Q369R, F376E, E380N, K382R, K384R, S403R, N407E, L408E |
| 240 | pA15883 | 6 | S4R, K5H, D6Q, L8G, R9Q, K10E, K11E, S21E, E25R, E29R, K32Q, E33R, G35R, D36R, Y37R, Q49H, F50R, E59R, K62R, N63E, F64E, K67R, K70R, K72E, E75D, D77R, K78Q, E94R, S96R, T98E, K102E, K104R, D105Q, K116R, D129Q, K137E, E140R, R141Q, I148E, E151R, T152R, V161E, S187R, S190E, S191E, K194R, N197P, W203R, Y219R, K229Q, G232E, K238R, E262Q, N287E, D290R, I292Q, K302R, R303E, E307R, K321D, D322T, K324D, K326H, E327R, L328E, W331E, E343D, E345P, K348R, M349E, N352R, K365R, Q369R, D373R, F376E, K382R, K384R, K392H, K393E, K396E, R397E, E400Q, S403R, N407E, L408R |
| 241 | pA15884 | 6 | L3E, S4E, K5H, D6R, Y7H, L8G, R9Q, K10E, K11F, S21E, K34Q, D36T, Q49H, F50R, K62R, N63R, M66E, K67E, K70R, E71R, E75D, D77R, K78M, E94R, S96R, K102R, K104R, D105E, K116T, K131E, Y135D, K137E, E140R, I148E, E151R, T152H, A153R, R154Q, K155Q, N157P, F158T, Q159E, S187R, S190E, S191A, K193Q, K194R, N197P, P200E, W203R, S218T, Y219R, K221R, E224Q, K229R, G232E, K238R, E240T, E262R, N287E, D290R, E297R, S299Q, N300D, K302R, K318D, K321E, D322T, R325Q, L328E, W331E, E343D, E345P, K348R, M349R, K353E, E356R, I364E, K365R, F376Q, E380D, K382R, K384T, N407H, L408R |
| 242 | pA15885 | 6 | S4R, D6Q, Y7N, L8N, R9E, K11R, S21P, K32R, K34R, G35N, N63R, K67E, K70R, E71S, E75D, D77R, K78R, E94L, T98E, N101R, K102R, K104E, D105E, K116R, K131E, V132T, Y135W, E144R, E151R, R154P, K155E, Y156V, N157P, F158N, Q159E, P160M, S191T, K193E, K194R, N197E, W203R, E240T, N287Q, D290R, E297H, N300D, K302R, K321D, K324D, R325Q, M349R, N352E, K353E, E356R, I364E, K365R, E380N, K382R, S403A, N407Q |
| 243 | pA15886 | 6 | S4E, D6Q, Y7N, L8N, R9Q, K10D, K11R, S21P, K32R, K34R, G35D, D36Q, N63R, K67E, K70R, E71Q, K78M, S96R, N101E, K104R, D105Q, K116R, D129Q, K131E, V132T, P134D, Y135W, E136R, K137E, E140R, R141L, E151R, R154P, K155E, Y156V, N157P, F158N, Q159E, P160M, S190E, S191T, K194R, N197S, W203A, G216N, D220R, K221E, K229Q, G232E, R258E, E262R, N287Q, D290R, E297H, K302E, K321D, K324D, R325Q, L328E, E343D, K348R, M349R, N352E, K353E, E356R, I364E, K365R, E380N, K382R, K384E, S403A, N407E |
| 244 | pA15887 | 6 | S4R, K5H, D6E, L8G, R9Q, K10R, K11E, S21R, K32Q, E33T, K34R, G35H, D36E, Y37R, Q49H, F50R, N63R, F64E, K67R, K70R, E75D, E94R, T98E, N101E, K102R, D105E, K116R, D129E, K131E, A153R, R154T, K155Q, V161E, S190E, S191Q, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | K193Q, K194R, Y195H, N197P, P200E, W203R, Y219R, K229Q, G232E, K238R, E240T, N287E, D290R, E297R, S299Q, N300D, K302R, K318N, K321D, D322T, K324D, R325E, L326H, E327R, L328R, W331E, E343N, E345P, K348E, M349E, N352R, K353R, I364P, K365E, Y368R, Q369R, F376E, K382R, K384Q, S403R, N407E, L408R |
| 245 | pA15888 | 6 | S4E, K5H, D6H, L8G, K10P, K11Q, S21E, E25R, E29R, K32Q, E33R, K34Q, G35H, D36H, Y37P, Q49H, F50R, K62R, N63R, M66E, K67Q, K70R, K72E, D77R, K78M, E94R, S96E, T98E, K102E, K104R, D105E, K116W, P130S, K131E, V132T, P134D, E136R, K137R, E147R, I148E, K155G, N157P, V179R, S190E, S191Y, K193R, K194Q, P200R, G216R, Y219R, K221R, K229Q, G232E, K238R, E240H, N287E, D290R, E297R, N300D, K302R, K318K, K321E, D322T, K324E, R325Q, L328R, E343D, E345P, K348R, M349E, N352R, K353R, G361P, K365R, Q369R, F376E, E380D, K382R, K384Q, N385P, K392L, K393H, K396E, R397E, E400R, L408D |
| 246 | pA15889 | 6 | S4R, K5H, D6H, L8N, R9E, K10P, K11Q, S21P, K32Q, E33H, K34R, G35H, D36E, Y37P, F50H, K62R, N63R, K67E, K70R, E71R, E75D, D77R, K78L, E94Q, S96E, T98E, K102Q, K104Q, D105E, K116L, D129Q, K131E, K137R, R141H, E147R, I148V, R154Q, K155D, N157P, P160L, S190E, S191H, K193R, K194Q, N197R, G216R, K221R, K229Q, G232E, K238R, D241P, N287Q, K302R, R303Q, D313P, K318D, K321D, K324D, L328R, E343D, K348R, M349R, N352E, K353R, E356R, G361P, K365R, Q369R, F376E, E380D, K382R, K384E, N385P, S403R, N407D, L408T |
| 247 | pA15890 | 6 | L3E, S4E, D6R, Y7H, L8G, K10E, K11R, S21E, K32I, K34M, D36Y, Q49W, F50S, M56W, K62R, N63R, M66E, K67E, K70R, E71R, E75D, E76P, K78M, E94L, S96E, T98E, N101E, K102Y, K104R, D105E, K116L, D129R, K131D, V132E, Y135R, K137E, E140R, R141W, E144D, E151R, T152Y, A153R, R154Q, K155T, Y156F, N157R, F158T, Q159E, S190E, S191Y, K193Q, K194R, N197P, W203R, S218T, Y219R, D220R, K221R, E224Q, K229R, G232E, K238R, E240T, E262R, N287E, D290R, E297R, S299Q, K302R, R303E, E307R, K318D, K321E, D322T, K324D, L328E, W331E, E343D, E345P, K348R, M349E, N352R, K353R, I364P, K365R, Q369R, F376E, E380R, K382E, K384T, S403A, N407W, L408D |
| 248 | pA15891 | 6 | S4R, K5H, D6Q, Y7N, L8N, R9E, K10P, K11V, S21P, E29R, F30A, K32Q, E33Q, K34T, G35N, D36T, F50H, K62R, N63E, K67R, K70R, E71S, K72T, E75D, D77R, K78R, E94Q, S96E, T98E, N101E, K102Q, K104R, D105Q, K116L, K131E, V132T, P134D, E136R, K137R, E151R, A153S, R154P, K155P, Y156R, N157P, F158N, P160T, S190E, S191H, K193R, K194Q, N197S, W203H, G216N, D220R, K221T, K229Q, R231E, G232E, E235R, K238R, E240T, R258E, E262R, N287Q, D290R, E297H, N300D, K302R, D313P, K318D, K321D, K324P, R325Q, L328E, E343D, K348R, M349R, N352E, K353Q, E356R, I364E, K365R, E380N, K382R, K384S, K392L, K393A, K396E, R397H, E400R, S403W, N407E |
| 249 | pA15892 | 6 | S4R, D6Q, Y7N, L8N, R9E, K10P, K11V, S21P, K32M, K34L, G35D, D36L, K62R, N63E, K67R, K70R, E71S, E75D, D77R, K78M, K104R, D105E, K116Q, K131E, V132T, Y135W, E151R, R154P, K155P, Y156V, N157P, F158N, Q159T, P160M, S191T, K193R, K194R, N197S, W203A, D204R, G216N, D220R, K221T, K238R, E240T, E297H, K318D, K321D, K324P, R325Q, L328E, E345P, K348R, M349E, N352R, K353L, I364E, K365R, K384Q, N407R |
| 250 | pA15893 | 6 | L3E, S4R, D6Q, Y7N, L8G, R9E, K10R, K11H, S21E, K32I, E33T, K34R, G35H, D36E, Y37R, K62R, N63R, F64E, M66E, K67R, K70R, E75D, D77R, K78L, K104E, D105E, K116Y, D129L, K131E, P134D, Y135W, E136R, K137E, E144R, T152R, A153R, R154T, K155Q, Y156Q, F158T, Q159E, P160F, V179I, S190E, S191W, K193R, K194R, N197P, W203R, Y219R, K229A, K238R, N287E, D290R, I292E, E297R, S299Q, N300D, K302R, Y315W, K318N, K321D, D322T, K324R, L326H, E327R, L328E, W331E, E343D, E345P, K348R, M349E, N352E, K353R, E356R, K365R, F366E, Q369R, F376E, K382R, K384R, S403R, N407E, L408N |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 251 | pA15894 | 6 | S4R, D6Q, Y7N, L8N, R9E, K10P, K11V, S21P, K34L, G35N, K62R, N63R, K67E, K70R, E71S, E75D, D77R, K78M, E94L, S96E, T98Q, N101H, K102Y, K104E, D105Q, K116R, K131E, V132T, P134D, Y135W, E136R, K137R, E144R, E151R, R154P, K155P, Y156V, N157P, F158N, Q159E, P160M, S191T, K193R, K194R, N197S, W203A, D204R, G216N, K221R, E224Q, K229Q, G232E, K238E, E240T, R258E, E262R, E297H, K318D, M349R, N352E, K353L, E356R, I364E, K365R, E380N, K382N, K384S, E389D, K392R, K396A, R397L, S403A, N407Q |
| 252 | pA15895 | 6 | S4R, D6Q, L8N, R9E, K10P, K11V, S21P, K32M, K34L, G35N, D36T, N63R, K67R, K70R, E71S, E75D, D77R, K78R, E94L, T98Q, N101E, K102Y, D105E, K116Q, K131E, V132T, R154P, K155P, Y156V, N157P, F158N, Q159E, P160M, S190E, K193R, N197S, K229Q, G232E, E240T, R258E, E262R, N287Q, D290R, E297H, N300D, K302R, D313P, K318D, K321D, K324P, R325Q, E343D, E345P, K348R, M349R, N352E, K353A, E356R, K384D, N385T, R397L |
| 253 | pA15896 | 6 | L3E, S4R, K5R, D6Q, Y7N, L8G, R9Q, K11E, S21E, E25K, K34R, G35H, D36S, Y37R, Q49H, F50R, N63R, F64E, K67R, K70R, E75D, D77R, K78R, E94R, T98E, K102E, K104R, D105Q, K116R, E147R, I148E, T152R, V161E, S190E, S191Y, K194R, N197P, W203R, K238E, I292Q, K318D, E343N, E345P, K348R, M349E, N352R, I364P, K365R, Y368R, Q369R, F376E, E380D, K382R, K384D, E389R, K392E, N407R, L408R |
| 254 | pA15897 | 6 | S4E, K5R, D6E, L8G, S21E, E33T, K34R, Y37R, Q49H, F50R, E59R, K62R, N63R, F64E, K67R, K70R, K78R, E94R, S96R, T98E, N101E, K102E, D105E, D129E, K137E, R141Q, S190E, K193E, K194R, N197P, P200E, W203R, S218T, Y219R, K221R, E224Q, E240T, N287E, D290R, I292Q, N300D, K302R, K318D, K321D, D322T, R325E, L326H, L328E, W331E, E343D, E345P, K348R, M349E, N352E, K365R, F376E, K382E, S403R, N407E |
| 255 | pA15898 | 6 | L3E, D6R, Y7H, L8G, K10E, K11H, S21E, Y22W, K32I, E33R, D36Y, M56W, K62R, N63R, M66E, K67E, E71R, E76P, D77R, K78M, S96E, N101Q, K104R, D105E, K131E, Y135D, K137E, E140R, E151R, T152Y, A153R, R154Q, K155Q, Y156F, S187R, S190E, S191A, K194R, N197P, W203L, Y219R, K229R, G232E, K262R, N287E, D290R, E297R, S299Q, N300D, K302R, K318D, K321E, D322T, K324D, R325Q, E327R, L328E, W331E, E343D, E345P, K348R, M349E, N352E, K353R, E356R, I364E, K365R, F366Y, F376Q, E380D, K382R, K384T, E389R, K392L, K396Q, R397L, S403A, N407Y, L408D |
| 256 | pA15899 | 6 | S4R, D6R, Y7N, L8G, R9E, K10P, K11V, S21R, K32Q, E33Q, K34Y, G35N, D36R, Y37E, E59R, K62R, N63R, M66E, K67E, E71S, E76P, D77R, K78R, I80L, S96E, N101Q, K104R, D105E, K116R, K131E, V132T, P134D, Y135W, E136R, K137E, E140R, E151R, K155T, N157P, F158N, Q159E, P160F, V179R, S190E, S191W, K193R, K194R, N197Q, G216T, D220P, K221R, K229N, G232E, K238R, E240T, N287E, D290R, E297H, K302R, R303E, E307R, D313P, K318D, K321R, K324E, R325E, E327R, L328R, W331E, E343N, E345P, K348E, M349R, N352Q, K353Q, E356R, I364E, K365R, Q369R, K384R, K392R, K396R, R397I, S403A, N407E |
| 257 | pA15900 | 6 | L3E, S4E, K5H, Y7H, L8N, R9Q, K10P, K11I, S21P, E25R, E33H, K34R, G35H, D36E, F50H, K62R, N63R, K67E, K70R, E71Q, K72R, E75D, D77R, K78R, E94R, S96E, T98E, N101E, K102E, K104R, D105Q, K116R, K137E, E140R, E150R, K155E, Y156R, N157E, Q159G, P160S, S190E, S191H, K193R, K194Q, N197Q, N201E, D204R, R205L, S218T, Y219R, K221Q, E224Q, K229R, G232E, E240T, N287R, K302R, R303E, E307R, K318D, K321D, K324D, E343D, K348E, M349R, N352R, G361D, I364E, K365R, Q369R, D373E, F376E, E380R, K382R, K384D, N385T, K393H, E400R, S403R, N407Q, L408R |
| 258 | pA15901 | 6 | L3E, D6Y, Y7H, L8N, R9E, K10P, K11R, S21P, Y22W, K32M, E33R, K34Q, K62R, N63Q, K67E, K70R, E71R, E75D, D77R, K78M, E94L, S96E, T98R, N101E, K102Y, K104R, D105Q, K116I, D129Q, K131D, V132R, Y135L, K137E, E140R, R141L, E151R, T152Y, R154Q, K155E, Y156F, N157D, F158R, Q159E, P160M, S190E, S191A, K193E, K194R, N197D, W203R, S218T, K221Q, K229R, R231E, G232E, E235R, K238Q, E240T, N287L, D290E, S299Q, N300D, K302R, D313P, K318D, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | K321D, K324D, E343D, K348R, M349R, N352E, K353L, E356R, I364E, K365R, F366Y, F376E, E380R, K382R, K384E, N385P, E389R, K392H, K396I, R397L, S403A, N407L, L408T |
| 259 | pA15902 | 6 | S4Q, K5Q, D6R, Y7N, L8G, R9Q, K11W, S21E, E25R, D32Q, K34S, G35N, D36T, N63R, K67Q, K70R, K72H, E75D, D77R, K78R, E94R, S96E, T98E, K102R, K104R, D105E, K116R, P134E, E136R, K137E, E140R, E147R, I148E, T152Q, A153S, R154S, K155T, Y156D, N157P, F158N, Q159P, P160T, V179R, S190E, S191E, K193R, K194R, Y195Q, N197Q, W203H, G216T, Y219R, D220R, K221R, K229Q, G232E, N287E, D290R, K302R, R303E, E307R, K321E, K324E, R325Q, E327R, L328E, W331E, I364E, K365R, Q369R, K384Q, K392R, K393R, R397E, S403R, N407E |
| 260 | pA15903 | 6 | L3E, S4E, K5H, Y7H, R9T, K11I, S21P, K32Q, K34Q, F50H, N63K, K67E, K70R, E71R, E75D, D77R, K78M, S96E, T98E, N101E, K102Q, D105Q, K116Y, D129Q, K137E, E140R, R141Q, A153Q, R154Q, K155E, Y156T, N157D, F158R, Q159E, S190E, S191H, K193E, K194R, N197D, W203R, S218T, D220R, K221T, K229R, G232E, E240T, N287H, D290Q, S299Q, N300D, K302Q, D313P, K318D, K321D, K324D, R325Q, L328E, E343D, K348R, M349R, N352E, K353H, E356R, I364E, K365R, Q369R, F376E, E380R, K382R, K384E, N385P, L408R |
| 261 | pA15904 | 6 | S4E, K5R, D6H, L8N, R9L, K10P, E33N, K34R, G35N, D36E, Y37P, E59T, K62R, N63D, M66Y, E75D, E76L, D77R, K78D, E94L, S96A, T98E, N101S, K102R, K104E, D105E, K116R, D129Q, K131E, P134H, Y135W, E136W, K137E, E140L, R141L, E144D, E147A, I148V, T152V, Y156F, P160L, V179I, S190Y, S191Y, K194E, Y195A, N197R, G216R, K221R, D228S, K229R, R231E, G232E, E262L, E297R, N300E, K321D, L328W, M349R, N352E, K353R, E356R, G361P, F376E, E380D, K382R, K384E, N385P, S403A, N407D |
| 262 | pA15905 | 6 | L3E, S4E, D6E, L8G, R9Q, K10E, K11Q, S21E, K32I, K34Q, D36Y, Q49H, F50R, M56W, K62R, N63R, M66E, K67E, K70R, E71R, E75D, D77R, K78M, E94R, S96E, T98E, N101R, K102E, K104E, D105E, K116L, D129W, K131D, V132E, Y135R, K137W, E140R, R141W, E144R, E151R, T152Y, A153R, R154Q, K155T, Y156F, F158T, Q159E, P160M, S190E, S191Y, K193R, K194R, N197P, W203R, S218T, Y219R, D220R, K221R, E224Q, K229R, G232E, E240T, E262R, E297R, S299Q, K321E, D322T, L328E, E343Q, K348R, M349R, N352E, K353E, E356R, I364E, K365R, F366Y, F376Q, E380D, K382R, S403A, N407W, L408R |
| 263 | pA15906 | 6 | S4P, K5H, D6H, L8G, K10P, K11F, S21E, Y22W, E29R, K32M, E33R, K34L, G35H, D36Y, Y37P, Q49H, F50R, M56W, E59T, K62A, M66Y, K67E, K70R, E71R, K72L, E75S, D77S, K78M, E94L, S96E, T98V, K102E, K104R, D105E, K116W, D129W, P130S, K131E, V132T, P134H, Y135W, E136Q, K137V, E140D, R141W, E147R, I148E, T152Q, K155G, Y156F, Q159W, V161I, V179R, S190E, S191Y, K193R, K194R, P200R, G216R, Y219R, K221R, D228S, K229Q, R231E, G232P, E235R, K238S, E240Y, E262L, N287R, E291R, E297R, N300E, K302M, K318D, K321E, D322T, S323G, K324P, R325Q, L328W, W331F, E343D, E345P, K348R, M349E, N352R, K353R, G361P, D363P, I364P, K365D, Y368R, Q369D, Y370H, D373E, Y375W, F376R, E380D, K382R, K384R, N385P, K392Y, K393H, K396E, R397L, E400R, S403A, N407L, L408D |
| 264 | pA15907 | 6 | S4R, D6Q, Y7N, L8N, R9E, K11V, S21P, K32M, E33R, K34L, G35N, Q49F, F50Q, K62R, N63E, K67R, K70R, E71S, E75D, D77R, K78M, E94L, S96R, T98Q, N101E, K102Y, K104R, D105Q, K116R, P134D, Y135W, E136Q, K137I, R141W, E151R, A153S, R154P, K155P, Y156V, N157S, F158N, Q159E, P160M, S190E, S191T, K193R, K194E, N197S, W203Y, G216N, D220T, K221E, N287Q, D290R, E297H, K302Q, K321R, S323D, K324H, R325Q, E343D, K348R, M349R, N352E, K353L, E356R, E380N, K382N, K384Q, K396M, R397L, S403A, N407Q |
| 265 | pA15908 | 6 | S4R, K5H, D6Q, Y7N, L8N, R9E, K10P, K11V, S21P, E29R, F30H, K32Q, E33R, K34H, G35N, F50H, N63R, K67R, K70R, E71S, K72T, E75D, D77R, K78R, E94Q, S96E, T98E, K102Q, K104R, D105E, K116Q, K131E, V132T, P134D, E136R, K137R, E144R, I148V, E151R, A153S, R154P, K155P, Y156Q, N157P, F158N, P160T, S190E, K193E, K194R, N197E, W203R, G216N, K221R, E224Q, K229Q, G232E, K238R, E240T, R258E, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | E262R, E297H, K318D, E343D, K348E, M349R, N352R, K353Q, D377R, E380N, K382E, K384D, N385T, K392L, K393A, K396E, N407Q |
| 266 | pA15909 | 6 | L3E, S4E, K5H, R9Q, K11F, S21E, K34Q, D36T, Y37E, Q49H, F50R, K62R, N63R, M66E, K67E, K70R, E71R, E75D, I80R, E94Q, S96E, N101E, K102E, K104R, D105E, K116T, K131D, V132E, Y135R, K137E, E140R, I148D, E151R, T152H, R154Q, N157P, F158E, Q159E, S190E, S191R, K194E, N197P, W203R, Y219R, K229R, G232E, E297R, S299Q, K318D, K321E, D322T, K324D, R325Q, E327R, L328E, E343Q, E345D, K348R, M349E, N352R, K353R, N407H, L408R |
| 267 | pA15910 | 6 | S4R, K5H, D6E, L8G, R9Q, K10P, K11E, S21E, E25R, E33R, G35H, D36E, Y37R, N63R, F64E, K67R, K70R, K72E, E75D, D77R, K78Q, S96E, K116R, D129E, P134D, E136R, K137E, R141Q, A153R, R154T, K155R, V161E, S190E, S191H, K193E, K194R, Y195H, N197P, P200E, W203R, S218T, Y219R, K221E, E224Q, K229Q, G232E, E240T, I292Q, K318N, K321D, D322T, L326H, L328E, K365R, Q369R, F376E, K382R, K384Q, E389R, K392H, K393H, K396E, E400R, S403R, N407R, L408R |
| 268 | pA15911 | 6 | S4M, K5V, D6Q, Y7N, L8N, R9I, K10P, K11I, S21P, K32M, G35N, D36S, N63R, K67E, K70R, E71S, K78M, S96A, N101S, K104Q, D105E, K116L, D129Q, K131E, V132T, P134D, Y135W, E136R, K137E, E140I, R141L, E144I, I148V, E151R, T152V, R154P, K155P, Y156V, N157P, F158N, Q159L, P160M, S190E, S191W, K193Y, K194R, N197S, W203A, K238S, E262L, N287L, D290E, E297H, N300D, K302L, D313P, K318P, K321E, K324P, R325A, L328D, W331L, M349E, N352K, K353L, E356R, N407L |
| 269 | pA15912 | 6 | D6Q, L8N, S21P, K34L, G35D, D36Q, E75D, D77R, K78R, S96E, N101E, K104Q, D105Q, K116R, D129Q, P134D, Y135W, E136R, K137E, E140R, R141L, E151R, R154P, K155E, Y156V, N157P, F158N, Q159E, P160M, S190E, S191T, K194R, N197S, W203A, K229R, R231E, G232E, E235R, K238S, D313P, K318D, K321D, K324P, R325Q, E343D, E345P, K348E, M349R, N352R, I364P, K365R, K384E, K392R |
| 270 | pA15913 | 6 | L8N, R9E, K10P, S21P, E33H, K34I, G35H, D36Y, Y37P, K62R, N63R, K70R, E75D, D77R, K78L, K104Q, D105E, K116R, E147R, R154Q, K155D, Y156F, N157P, Q159L, S190E, K193R, N197S, G216R, D220R, K221E, E240M, N287L, D290E, K302R, R303E, E307R, K324D, R325E, L328E, E343D, K348E, M349R, N352R, G361P, K365R, Q369R, F376E, E380D, K382R, K384E, N385P, S403A, N407F, L408T |
| 271 | pA15914 | 6 | S4R, Y7N, L8N, R9E, K10P, K11V, S21P, K34L, G35S, Q49F, F50Q, N63E, K67R, K70R, E71S, K78M, E94L, S96E, T98Q, N101E, K102Y, D105Q, D129Q, K131E, V132T, P134D, E136R, K137E, E140R, R141L, A153S, R154P, K155P, Y156Q, N157P, F158N, S190E, K193R, N197S, K229Q, G232E, E240T, N287Q, D290R, K302Q, K321D, K324P, R325Q, E343D, E345P, K348E, M349R, N352R, I364P, K365R, F366Y, Q369R, Y375A, E380N, K382N, S403A, N407Q |
| 272 | pA15915 | 6 | S4R, D6Q, Y7N, L8N, R9E, K10P, K11V, S21P, K32M, E33R, K34T, G35N, N63R, K67R, K70R, E71S, E75D, D77R, K78M, S96E, K116Q, D129Q, P134D, E136R, K137E, E140R, R141L, R154P, K155P, Y156V, N157P, F158N, Q159T, P160I, S190E, K193R, K194E, N197E, K229Q, G232E, E240T, N287Q, D290N, N300D, K302R, D313P, K318D, K321D, K324P, R325Q, K396M, R397L, S403L, N407Q |
| 273 | pA15916 | 6 | S4E, D6H, L8G, K10E, K11Q, S21E, Y22W, K32M, E33Q, K34L, G35H, D36N, Y37P, Q49W, F50S, M56W, K62R, N63R, M66E, K67E, K70R, E71R, E75D, D77R, K78L, E94L, S96E, T98Q, N101Q, K102Y, K104Q, D105E, K116E, K131E, V132T, P134D, Y135W, E136R, K137R, E147R, R154S, K155G, Y156F, N157P, Q159R, V161I, V179R, S190E, S191Y, K193R, K194Q, P200R, G216R, Y219R, K221R, K229R, G232E, K238R, E240Y, E262Q, N287L, D290E, E297N, N300D, K302R, K318D, K321E, D322T, K324D, R325Q, E327R, E343D, E345P, K348R, M349E, N352R, K353R, G361P, I364P, K365R, Q369R, D373R, F376E, E380D, K382R, K384Q, N385P, K392R, K396R, R397L, L408D |
| 274 | pA15917 | 6 | S4R, K5H, D6Q, L8N, R9E, K11V, S21P, F30H, K32Q, K34H, G35N, F50H, N63R, K67E, K70R, E71S, E75D, D77R, K78R, E94Q, S96E, T98E, N101E, K102Q, D105E, K116R, P134D, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | E136R, K137R, A153S, R154P, K155P, Y156Q, N157P, F158N, Q159E, P160T, S190E, K193R, N197S, W203H, K229Q, G232E, E240T, N287Q, D290Q, K302R, R303E, E307R, K321D, K324P, R325Q, E343D, K348E, M349R, N352R, K384Q, N407Q |
| 275 | pA15918 | 6 | S4R, D6Q, Y7N, L8N, R9E, K11V, S21P, D36Y, N63E, K67R, K70R, E71S, E94L, T98Q, N101E, K102Y, D105E, K116R, K131E, V132T, A153S, R154P, K155P, Y156V, N157P, F158N, Q159E, P160M, S190E, S191T, K193R, K194Q, N197E, W203Y, K229Q, G232E, E240T, N287Q, D290R, K302Q, K318D, K321D, K324P, R325Q, I364E, K365R, K384Q, N407E |
| 276 | pA15919 | 6 | S4D, K5H, D6H, L8G, K10P, K11F, F30A, K32M, E33N, K34Q, G35H, D36Y, Y37P, Q49H, F50R, M56W, K62R, N63R, M66E, E75S, E76L, D77S, K78M, E94Y, T98W, K102E, K104R, D105E, P130S, K131E, V132T, Y135W, E136R, R141W, E147R, I148E, T152Q, K155G, Y156F, N157P, V179R, S190E, S191E, K193R, K194E, N197R, P200L, G216R, Y219R, K221R, D228S, K229Q, R231E, G232P, E235R, K238W, E240Y, E262L, N287L, E297R, N300E, K302P, D313P, K318D, K321E, D322T, K324D, R325Q, E327R, L328W, W331L, M349R, N352E, K353Q, E356R, G361P, D363P, I364P, K365E, Y368R, Q369R, Y375W, F376E, E380D, K382R, K384R, N385P, S403W, N407L, L408D |
| 277 | pA15920 | 6 | L3E, S4R, K5H, D6E, L8G, R9Q, K10A, K11F, S21E, K32I, E33T, K34R, G35H, D36E, Y37R, Q49H, F50R, E59S, K62R, N63R, F64E, M66F, K67R, K70R, E75D, D77R, K78L, E94Y, S96R, T98W, K102E, K104R, D105Q, K116Y, D129E, K131E, Y135W, E136P, K137E, E144D, I148E, E151T, T152R, A153R, R154T, K155Q, Y156F, F158T, Q159E, V161W, V179I, S187R, S190E, S191W, K193R, K194R, N197P, P200M, W203Y, S218E, Y219R, K221R, E224Y, K229A, G232P, E235W, K238S, E240T, N287L, E297R, S299Q, N300E, K302L, D313P, Y315W, K318D, K321D, D322T, K324W, R325W, L326H, L328W, W331F, E343D, E345P, K348R, M349E, N352E, K353R, E356R, D363H, I364P, K365E, Y368R, Q369R, F376E, E380N, K382R, K384R, S403Y, N407F, L408W |
| 278 | pA15921 | 6 | S4R, K5F, D6H, L8N, R9E, K10P, K11I, S21E, K32M, E33H, K34I, G35H, D36Y, Y37P, E59T, K62R, N63D, K70R, E75D, D77R, K78L, E94L, S96A, T98Q, N101T, K102Y, D105E, K116L, K131E, P134H, Y135W, K137E, P160L, V179I, S190Y, S191Y, K194E, N197R, G216R, K221V, D228S, K229Q, R231E, G232E, E262L, E297R, N300Q, D313P, K318D, K321D, K324D, E327I, L328W, E343D, E345P, K348Y, M349Y, N352L, K353L, E356W, G361P, D363P, I364L, K365P, F366H, Y368R, Q369D, F376E, E380D, K382R, K384S, S403A, N407W, L408T |
| 279 | pA15922 | 6 | L3E, S4L, K5H, Y7N, L8G, R9Q, K10R, K11F, S21E, E33N, K34R, G35H, D36W, Y37R, N63R, F64E, K67R, K70R, D77N, K78M, K116Y, D129E, K131E, Y135W, E136P, A153R, R154T, K155Q, Y156Q, F158T, Q159E, P160F, V161W, V179I, S190E, S191W, K194R, N197W, W203L, S218E, Y219R, K221T, E224Y, K229A, G232P, N287L, E297R, S299Q, N300E, K302L, K321S, D322T, R325S, L326H, L328W, W331F, E343D, E345P, K348R, M349E, N352R, K353D, D363H, I364P, K365S, Y368R, Q369D, F376E, K382R, S403W, N407Y, L408W |
| 280 | pA15923 | 6 | L3E, S4E, L8G, R9Q, K10R, K11R, S21E, K34R, D36E, F50H, M56W, K62R, N63Q, M66E, K67E, K70R, E71R, E75D, E76P, E94L, S96E, T98E, N101R, K102E, D105E, K131S, E136Q, K137E, E140R, E150A, K155D, Y156Q, N157E, Q159E, P160R, S190E, S191Y, K193R, K194R, N197S, N201R, R205Q, Y219R, K229Q, G232E, N287R, N300D, K302R, K321E, L326H, E343Y, E345P, K348R, M349E, N352E, I364E, K365R, Y368R, Q369R, F376E, E380N, K382R, S403W, L408R |
| 281 | pA15924 | 6 | S4E, K5H, D6H, L8G, R9Q, K11Q, S21Q, K34Q, G35H, D36H, Y37P, Q49H, F50R, K62R, N63R, M66E, K67E, K70R, E71R, E75D, D77R, K78L, E94R, T98E, N101E, K102E, K104R, P130S, K131E, V132T, E136R, E147R, I148E, V179R, S190E, S191Y, K194E, N197R, W203R, Y219R, K229Q, G232E, K238R, K321E, D322T, K324D, R325Q, E327R, L328E, E343Q, E345P, K348Q, M349E, N352R, G361P, I364E, K365E, Y368R, Q369R, K384R, N385P |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 282 | pA15925 | 6 | S4L, K5H, D6Q, L8G, R9Q, K10R, K11F, S21E, Y22W, E25R, E29Q, K32I, E33T, K34R, G35H, D36H, Y37R, Q49H, F50R, N63R, F64E, K67R, K70R, K72E, D77N, K78M, E94Y, S96R, T98W, N101E, K102E, D105E, K116Y, D129L, K131E, P134H, Y135W, E136S, K137E, R141Q, A153R, R154T, K155Q, Y156Q, F158T, Q159E, P160F, V161Y, V179I, S190E, S191Q, K193R, K194R, Y195H, N197P, P200M, W203Y, Y219R, K229A, G232P, E240T, I292Q, K321D, D322T, R325D, L326H, L328W, E343D, E345P, K348R, M349E, N352R, D363H, I364P, K365S, Y368R, Q369D, D373F, F376E, K382R, K384R, K392F, K393R, K396R, R397E, E400Q, S403Y, N407F, L408W |
| 283 | pA15926 | 6 | S4R, D6H, L8N, R9E, K10P, K11Q, S21P, E33H, K34R, D36E, K155D, N157P, G216R, K221R, K229Q, G232E, K238R, D241P, N287Q, K302R, K321D, K324D, E343D, K348E, M349E, N352R, G361P, K365R, Q369R, K384E, N385P, S403R, N407D, L408T |
| 284 | pA15927 | 6 | S4D, K5A, D6H, L8G, K10P, K11F, S21E, Y22W, E25R, E29R, E33R, K34L, G35H, D36Y, Y37P, Q49H, F50R, N63R, K67R, K70R, K72L, D77N, K78M, E94Y, T98W, N101Q, K102E, D105E, K116W, P130S, K131E, V132T, K155G, Y156F, Q159W, V161I, G216R, Y219R, K221R, K238S, E262L, N287F, D290R, E297R, N300R, K302R, R303D, K318D, K321E, D322T, K324D, R325Q, E327Q, L328Y, W331E, E343N, E345P, K348E, M349E, N352R, K353P, G361P, D363P, I364P, K365E, Y368R, Q369R, F376E, E380D, K382R, K384Q, N385P, K392F, K393H, K396E, R397L, E400R, S403A, N407L, L408D |
| 285 | pA15928 | 6 | S4R, K5H, D6Q, Y7N, L8N, R9E, K10P, K11V, S21P, E25R, K34T, G35N, N63R, K67E, K70R, E71Q, K72T, K78R, N101E, K104R, D105Q, D129Q, K131E, V132T, R141Q, E151R, A153S, R154P, K155P, Y156Q, N157P, F158N, K229Q, G232E, R258E, E262R, N287Q, D290R, E297H, K302Q, R303P, E307Q, D313P, K318D, K321D, K324P, R325Q, E343D, K348R, M349E, N352E, K353Q, E356R, I364E, K365R, E380N, K382N, S403R, N407Q |
| 286 | pA15929 | 6 | L3E, S4Q, K5H, D6R, L8N, K11Y, K32Q, D36T, E75D, D77R, K78M, K116Y, K131D, V132N, A153Q, R154Q, K155E, Y156T, N157D, F158R, K193E, N197D, W203R, K229R, G232E, E240T, S299Q, D313P, K318D, M349R, N352E, K353Q, E356R, I364E, K365R, Q369R, F376E, E380K, K382R, K384E, N385P |
| 287 | pA15930 | 6 | S4L, K5V, D6Q, Y7W, L8N, R9I, K11I, S21P, Y22W, E25I, E29L, F30T, K32M, K34F, G35N, D36Y, E59S, K62R, N63D, M66Y, K67E, K70L, E71Q, K72L, E76L, K78M, E94L, S96A, T98R, N101T, K102Y, K104R, D105Q, K116L, D129Q, K131E, V132T, P134D, Y135W, E136R, K137Q, E140I, R141Y, I148V, E151R, T152V, R154P, K155P, Y156V, N157P, F158N, Q159L, P160M, S190E, S191T, K193L, K194R, N197S, W203A, D204S, D228S, K229Q, R231L, G232P, E240T, E297H, D313P, K318D, K321R, K324P, R325A, L328D, M349R, N352E, K353L, E356R, D377A, K384S, E389D, K392L, K393W, R397L, E400L, S403W, N407I |
| 288 | pA15931 | 6 | S4R, D6H, L8G, R9E, K10P, K11Q, S21E, Y37P, K116E, K155G, Y156F, N157P, Q159R, V161I, V179R, G216R, Y219R, K221R, V222I, K229Q, G232E, N287E, D290R, N300D, K302R, K321E, R325Q, W331E, E343D, E345P, K348R, M349E, N352R, G361P, F376E, E380D, K382R, K384R, N385P, L408N |
| 289 | pA15932 | 6 | S4M, K5V, D6Q, Y7N, L8N, R9L, K10P, K11Y, S21P, F30A, K34Y, G35N, D36F, N63E, K67R, K70R, E71S, K78M, S96A, D129Q, K131E, V132T, P134D, E136R, K137I, E140I, R141Y, R154P, K155P, Y156V, N157P, F158N, P160M, K238S, E262L, N287L, D290R, E297H, N300D, K302L, K321R, K324P, R325A, W331F, E343M, E345P, K348W, M349T, N352M, K353L, I364E, K365R, Q369L, S403W, N407I |
| 290 | pA15933 | 6 | S4L, K5V, D6Q, Y7W, L8N, R9I, K10P, K11I, F30A, K32M, K34T, G35D, D36Q, K70R, E71S, K78M, S96A, D129Q, K131E, V132T, P134D, E136R, K137Q, E140I, R141Y, R154P, K155P, Y156V, N157P, F158N, P160M, K193L, N197S, W203A, D204N, D228S, K229Q, R231E, G232E, E235D, K238S, E240T, E262L, N287L, D290R, N300D, K302L, D313P, K318D, K321R, K324P, R325A, W331L, K384L, S403W, N407L |
| 291 | pA15934 | 6 | S4R, D6Q, L8G, R9H, K11E, S21R, K34L, G35H, D36S, Y37R, N63R, F64L, K67E, K70R, E71R, E75D, D77R, K78L, N101Q, K104R, D105E, K116Y, D129E, K131E, E144Q, E151R, T152Y, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | A153R, F158T, S190E, K193R, K194R, N197P, W203R, Y219R, E240T, N287P, D290R, N300D, K302R, K321D, D322T, R325E, L326H, L328R, W331E, E343Y, E345P, K348E, M349R, N352R, D373N, F376E, K382R, K384Q, R397S, N407H, L408R |
| 292 | pA15935 | 6 | S4E, K5L, D6L, Y7W, L8N, R9Q, K10P, K11V, F30T, D36W, Q49F, F50Q, E59S, K62R, N63D, M66Y, K67Q, E76L, E94L, S96A, T98Q, N101E, K102Y, D105I, K116L, P125A, D129Q, K131Y, V132Y, P134D, E136R, K137Q, E140I, R141Y, K154P, K155P, Y156V, N157P, F158N, Q159L, P160M, S190E, S191T, K194P, N197S, W203F, E262L, N287L, D290R, N300D, K302L, D313P, K318D, W331L, I364E, K365R, F366Y, Q369L, D377A, E380R, K382E, K393W, K396I, R397L, E400Y, S403W, N407I |
| 293 | pA15936 | 6 | S4M, K5V, D6Q, L8N, R9L, K10P, K11Y, S21P, F30A, K34Y, G35N, D36F, K70D, E71S, E76R, K78M, Y135W, R154P, K155P, Y156V, N157P, F158N, P160M, S190E, S191T, K193Y, K194R, N197S, W203A, E262L, N287L, D290R, N300D, K302L, W331L, E343D, K348A, M349R, E380L, K382R, S403W, N407I |
| 294 | pA15937 | 6 | S4M, K5L, D6Q, R9I, K10N, K11I, S21P, F30A, K32Q, K34Y, G35D, D36L, E59S, K62R, N63D, K67E, K70D, E71R, E76R, D77N, K78R, S96A, N101A, K104E, D105E, K116T, K131E, V132T, Y135L, K137V, E144R, I148V, E151R, K155E, F158N, P160E, S190D, S191T, K193R, K194R, N197E, W203Y, D204N, E240T, E262L, N287F, D290Q, K302L, D313P, K318D, K321D, K324E, W331L, E343P, E345P, K348E, M349T, N352R, I364P, K365R, E380R, K382L, S403F, N407I |
| 295 | pA15938 | 6 | S4E, D6H, L8G, K11H, S21E, K32M, E33Q, G35D, D36E, Y37P, Q49F, F50S, M56W, K62R, N63R, M66E, K67E, K70R, E71R, E75D, E76P, I80Q, E94Y, S96C, T98Q, N101Q, K102W, K104R, D105E, K116E, D129W, K137V, R141W, E147Y, Y156F, Q159R, V161I, V179R, S191L, G216R, Y219R, K221R, K229Q, G232E, K238R, K321E, D322T, K324D, R325Q, E327R, E343D, E345P, K348R, M349E, N352R, G361P, K365R, Q369R, F376E, E380R, K382Q, K384R, N385P, N407H, L408D |
| 296 | pA15939 | 6 | S4M, K5L, D6Q, R9I, K10N, K11I, S21P, F30H, K32Q, K34T, G35N, E59S, K62R, N63D, K67S, D77N, K78R, S96A, N101E, K104R, D105Q, K116T, K131E, V132T, Y135L, K137V, I148V, E151R, K155E, F158N, P160E, S191T, K193R, K194D, N197S, W203Y, D204N, G216R, K221Q, D228S, K229Q, R231E, G232E, E235R, K238S, E240T, E262L, D290R, E297L, K302L, D313P, K318D, K321D, K324W, W331L, E345P, K348E, M349E, N352R, K353Q, I364P, K365R, F366Y, K384Q, S403T, N407Q |
| 297 | pA15940 | 6 | S4M, K5V, D6Q, L8N, R9L, K10P, K11Y, S21P, Y22W, F30T, E33Q, K34Y, G35N, D36F, E59S, K62R, N63D, K67E, K70R, E71Q, E75D, D77R, K78M, E94L, T98Q, N101K, K102Y, D105E, K116L, Y135W, Q159E, P160M, S191T, K193L, K194A, N197S, W203A, D204R, E240T, E262L, N287L, D290R, N300D, K302L, D313P, K318D, K321R, K324P, R325A, W331L, I364E, K365R, F366Y, Q369L, D377A, K384S, E389D, K392L, K393W, K396I, R397L, E400Y, S403W, N407I |
| 298 | pA15941 | 6 | S4M, K5H, D6E, L8G, K11F, E33N, K34R, G35H, D36H, Y37R, E75D, D77R, K78L, S96R, K104R, D105E, K116Y, D129E, P134H, Y135W, E136S, K137R, R141D, E144D, I148E, E151R, T152R, Y156E, F158T, P160F, V161E, V179I, S187Q, S190E, S191Q, K193I, K194R, Y195H, N197P, P200L, W203L, S218T, Y219R, K221T, E224Y, K229A, G232P, E240T, I292Q, K321S, D322T, R325S, L326H, L328W, E343Y, E345P, K348E, M349W, N352R, D363H, I364P, K365S, Y368R, Q369D, F376E, K382S, S403Y, N407F |
| 299 | pA15942 | 6 | L3E, S4R, K5H, Y7N, R9Q, K11F, S21E, Y22W, E25R, E29R, E33T, K34R, D36F, Y37R, Q49H, F50R, E59S, K62R, N63D, F64E, M66Y, K67R, K70R, K72E, K78R, E94Y, T98W, N101E, K102E, D105E, K116Y, D129E, K131E, Y135W, E136P, A153R, R154T, K155Q, Y156F, F158T, Q159E, P160F, V161W, V179I, S190E, S191W, K194R, N197W, W203L, S218T, Y219R, K221T, E224Y, K229A, G232P, N287D, D290F, I292Q, K302L, R303E, E307R, K321S, D322T, R325S, L326H, L328W, W331F, D363H, I364P, K365S, Y368R, K384R, K392H, K396M, S403Y, N407F, L408W |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 300 | pA15943 | 6 | S4D, K5Q, D6R, Y7N, L8G, R9Q, K10P, K11W, S21E, E25R, K32Q, G35D, D36Q, K62A, N63R, M66Y, K67E, K70R, K72H, E75R, K78R, N101Q, K104R, D105E, K116Y, Y135W, E136P, I148V, E151R, T152V, R154Q, K155W, N157P, F158N, Q159L, P160F, V179R, S190E, S191W, K193R, K194R, N197E, P200L, D228S, K229Q, R231F, G232P, E240T, D241R, E262L, E343D, E345P, K348R, M349R, D363H, I364E, K365S, Q369R, E380N, K382N, N407E |
| 301 | pA15944 | 6 | S4E, K5H, D6H, L8G, K10P, K11F, S21E, K34L, G35H, D36Y, Y37P, M56W, E59S, K62R, N63D, M66F, K67E, E71R, E75D, E76L, D77R, K78L, V179R, G216R, Y219R, K221R, D228S, K229Q, G232P, E262L, N287L, N300D, K302P, K321E, D322T, K324D, R325Q, E327R, L328W, W331L, E343D, E345P, K348R, M349E, N352E, G361P, D363P, K365D, Y368R, Q369R, K384P, N385P, L408D |
| 302 | pA15945 | 6 | S4R, K5F, D6H, L8N, R9E, K10P, K11I, S21P, F30A, K32M, E33H, K34V, G35H, D36E, Y37P, Q49W, F50Q, E59T, K62R, N63D, K67T, K70R, E75D, D77R, K78L, E94L, S96A, T98Q, N101T, K102Y, K104Q, D105I, K116L, D129W, P130S, K131E, Y135W, K137L, R141L, E147R, I148V, T152V, A153G, R154Q, K155D, Y156M, N157P, Q159L, P160M, V179I, S190Y, S191Y, K193F, K194L, P200L, W203R, G216R, K221V, E224M, D228S, K229Q, R231Z, G232P, E235E, K238S, E240Y, D241P, E262L, N287L, E297R, N300Q, K302I, D313P, K318D, K321D, K324D, E327Y, L328W, W331L, E343L, E345P, K348W, M349Y, N352L, K353L, E356W, G361P, I364L, K365R, Y368L, Q369R, F376E, E380D, K382R, K384S, S403W |
| 303 | pA15946 | 6 | S4P, K5A, D6H, K10E, K11H, S21R, K32Q, E33N, K34M, G35H, D36E, Y37P, M56W, E59S, K62R, N63D, M66Y, E75R, E76L, K78L, E94L, S96E, T98I, N101Q, K102Y, K104R, D105E, K131E, V132T, P134D, Y135L, E136T, K137R, E147R, I148E, V179I, S190D, S191R, K193R, K194E, G216R, K221Q, K229Q, G232P, E262Q, N287R, K302P, R303E, E307R, K321R, D322T, K324E, R325D, E327R, L328Y, E345P, K348Q, M349E, N352R, K353R, G361P, D363P, I364P, K365N, F376E, E380R, K382L, K384R, N385P, S403A, N407H, L408D |
| 304 | pA15947 | 6 | S4D, K5H, D6H, R9L, K10N, K11I, S21P, K32A, E33N, K34M, G35H, D36L, Y37P, E59S, K62R, N63D, K67D, K70D, E71R, E75D, E76R, D77N, K78L, E94L, S96A, T98Q, N101D, K102Y, K104D, D105Q, K116T, K131E, K137V, E147R, I148V, K155E, P160A, V179I, S190E, S191L, K193R, K194R, G216R, K221I, D228S, K229Q, R231E, G232E, E235R, K238S, D241N, E262L, N287H, D290E, K302I, R303E, E307R, D313P, K318D, K321D, K324E, L328Y, W331L, E345P, K348R, M349T, N352E, K353L, E356R, G361P, D363P, I364L, K365S, F376E, E380R, K382L, K384E, S403A |
| 305 | pA15948 | 6 | S4D, K5A, D6H, K10D, K11I, S21P, E25R, E29I, K32I, E33R, K34T, E59S, K62R, N63D, K67S, K70D, K72L, E75D, E76R, D77N, K78L, E94L, S96A, T98R, N101E, K102Y, K104R, D105Q, R108I, K116T, K131E, V132R, Y135L, K137V, E140R, E151R, T152Y, R154Q, K155E, F158V, S187A, S190E, S191A, K193R, K194R, N197D, W203F, D220E, K221T, D228S, K229R, R231E, G232E, E235R, K238S, E240D, D241Q, R258L, E262R, N287H, D290E, S299A, K302I, R303E, E307R, D313P, K318D, K321D, K324E, L328Y, W331L, E345P, K348L, M349T, N352E, K353L, E356R, I364M, K365R, F366Y, F376E, D377R, E380R, K382E, K384T, N385P, K392L, K393T, K396M, R397L, S403A, L408D |
| 306 | pA15949 | 6 | L3T, S4D, K5H, D6N, K10E, K11I, S21E, K32I, K34M, D36S, M56W, E59S, K62R, N63D, M66F, K67E, K70D, E71R, E76R, D77N, K78L, E94L, S96E, T98R, N101R, K102Y, K104E, D105E, K116T, K131E, Y135L, K137R, E144R, I148V, E151R, T152Y, A153R, R154Q, K155Q, F158V, S187A, S190E, S191A, K193R, K194R, N197S, P200M, W203Y, D220Q, K221T, E224Y, D228S, K229R, R231E, G232E, E235R, K238S, E240T, E262Q, N287E, D290R, K302I, R303E, E307R, D313P, K318D, K321D, D322T, K324E, R325D, L328Y, W331L, E343N, E345P, K348R, M349T, N352K, K353R, I364P, K365R, F366L, F376E, E380R, K382L, K384T, S403A, N407H, L408D |
| 307 | pA15950 | 6 | S4M, K5L, D6Q, R9I, K10N, K11I, E25R, E29I, F30A, K32L, E33R, K34Y, G35D, D36L, E59S, K62A, N63E, M66Y, K67R, K70Q, K72I, D77N, K78R, S96A, K116T, K131E, V132T, Y135L, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | K137V, K155E, F158N, P160E, S191T, K193R, K194D, N197S, W203Y, D204N, G216R, K221Q, D228S, K229Q, R231E, G232E, E235R, K238S, E240T, E262L, N287F, D290Q, K302L, D313P, K318D, K321R, K324E, R325D, W331L, E345P, K348E, M349T, N352R, D377S, E380R, K382L, K384S, E389D, K392L, K393Y, K396M, R397L, S403F, N407I |
| 308 | pA15951 | 6 | S4N, K5Q, D6Q, K10R, K11E, S21P, K32Q, K34Y, G35N, D36R, E59S, K62R, N63D, M66F, K67E, K70D, E71R, E76R, D77N, K78R, S96E, K104R, D105E, P130S, K131E, V132T, E136P, K137R, E144I, I148E, E151R, K155E, F158N, S190E, S191Y, K193R, K194R, N197L, G216R, K221Q, K229N, G232P, D241R, K321R, K324E, R325D, E327R, E343N, E345P, K348E, M349N, N352R, I364P, K365R, S403A, N407E |
| 309 | pA15952 | 6 | S4L, K5L, D6Q, K10N, K11I, S21P, N63R, K67E, K70D, E71R, E76R, E94L, S96A, T98Q, N101E, K102Y, D105E, K116T, Y135L, K137V, K155E, F158N, P160E, S190D, S191T, K193R, K194R, N197S, W203Y, K238S, E262L, N287F, D290Q, K302L, D313P, K318D, W331L, I364P, K365R |
| 310 | pA15953 | 6 | S4M, K5L, D6Q, R9I, K10N, K11I, S21P, E25R, K32L, K34T, G35N, E59S, K62R, N63E, K67R, K70Q, K72I, K78R, N101A, K104E, D105E, K131E, V132T, Y135L, E144R, I148V, E151R, K155E, F158N, P160E, S190D, S191T, K193R, K194R, N197S, W203Y, D204N, D228S, K229Q, R231E, G232E, E235R, K238S, E240T, E262L, E297L, D313P, K318D, K321D, K324E, M349I, N352E, K353L, E356R, I364P, K365R, D377R, E380N, K382D, K393Y, S403L, N407Q |
| 311 | pA15954 | 6 | K5A, D6Q, S21P, K32Q, K34Y, G35N, D36T, N63R, K67E, K70D, E71R, E76R, D77N, K78R, N101A, K104E, D105E, Y135L, E144R, I148V, E151R, K155E, F158N, P160E, S190E, S191T, K193E, K194R, N197S, W203F, G216R, K221Q, K238S, E297L, K321D, K324E, M349I, N352E, K353L, E356R, I364P, K365R, K384Q |
| 312 | pA15955 | 6 | L3T, S4D, K5H, K10R, K11V, S21E, E25R, E29R, K32R, E33D, K34D, G35D, D36T, F50H, E59S, K62R, N63D, M66Y, K67R, K70D, K72E, E75R, E76R, K78R, E94R, S96E, T98E, K102E, K104E, D105E, D129K, K131S, V132S, E136P, K137R, I148E, E151R, T152Y, R154E, K155Q, F158L, S190E, S191Y, K193R, K194E, N197R, P200E, D228S, K229Q, R231E, G232P, E235R, K238S, E240T, N287F, D290E, K302I, R303E, E307R, K318N, K321R, K324E, R325G, L328Y, W331L, D363P, K365N, D373E, F376E, D377N, E380K, K382L, K384Q, E389R, K392L, K393E, K396M, E400R, S403A, N407R |
| 313 | pA15956 | 6 | S4M, K5L, D6Q, R9I, K10N, K11I, S21P, E29R, K32Q, E33R, K34T, G35N, D36L, N63R, K67E, K70D, E71R, K72T, E76R, D77N, K78R, E94L, S96A, T98Q, N101E, K102Y, D105E, K131E, V132T, K137V, K155E, F158N, P160E, K193R, K194R, N197S, W203Y, D228S, K229Q, R231A, G232P, E240T, E262L, N287F, D290Q, K302L, R303E, E307R, W331L, E345P, K348E, M349T, N352R, D377S, K382L, K384S, E389D, K392L, K393Y, K396M, R397L, S403L, N407Q |
| 314 | pA15957 | 6 | S4M, K5L, D6Q, R9I, K10N, K11I, E29R, F30A, K32Q, K34Y, G35N, D36E, E59S, K62R, N63D, K67E, K70D, E71R, K72T, E76R, D77N, K78R, S96A, N101E, K104R, D105Q, K116T, Y135L, K137V, I148V, E151R, P160E, S190E, S191T, K193R, K194A, N197S, W203Y, G216R, K221Q, E262L, D290E, K302L, R303E, E307R, D313P, K318D, W331L, E345P, K348E, M349T, N352R, E380R, K382L, K384S, E389D, K392L, K393A, K396I, R397L, E400R, S403F, N407H |
| 315 | pA15958 | 6 | S4P, K5A, D6H, K10E, K11H, S21E, E33N, K34M, D36E, M56W, E59S, K62R, N63D, M66Y, K67E, K70D, E71R, E76R, K78R, K131E, V132T, E136D, K155E, Y156M, S190E, S191R, K193R, K194E, N197R, Y219G, K238S, E262Q, N287R, K302I, R303E, E307R, K321R, D322T, R325G, L328Y, W331L, E343N, E345P, K348R, M349E, N352R, G361P, K384R, N385P, S403A, N407H, L408D |
| 316 | pA15959 | 6 | L3T, S4D, K5H, D6A, K10E, K11I, S21E, E25R, E29R, K32I, D36R, N63R, K67E, K70D, K72E, E75R, E76R, K78L, S96E, N101Q, K104R, D105E, K116T, K131E, P134D, Y135D, K137R, E140R, I148V, E151R, T152Y, A153R, R154Q, K155Q, N157R, F158V, S187R, S190D, S191A, K193R, K194R, N197S, W203F, Y219G, K221Q, D228S, K229R, R231E, G232P, E235R, K238S, E262R, E299A, K318D, E343N, E345P, K348R, M349E, |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| | | | N352R, K353R, I364P, K365R, F366Y, D373E, F376E, E380R, K382L, K384R, E389D, K392L, K393A, K396M, R397L, E400R, L408D |
| 317 | pA15960 | 6 | S4P, K5A, D6H, K10R, K11R, S21E, E33N, K34M, N63R, K67E, K70D, E71R, E75R, E76R, K78L, S96E, K104R, D105E, K116D, K131E, V132T, P134A, Y135L, E136P, K137R, E147R, I148E, K155Q, Y156M, Q159R, V179I, S190E, S191Y, K193R, K194R, Y219G, D228S, K229Q, G232P, N287R, K302I, R303E, E307R, K321S, D322T, S323G, R325D, L328Y, W331L, E343N, E345P, K348R, M349R, N352R, K353R, I364P, K365S, F366L, F376E, E380R, K382L, N407H, L408D |
| 318 | pA15961 | 6 | S4M, K5Q, D6A, R9I, K10A, K11I, S21E, E25R, E29R, F30A, K32Q, E33N, K34Y, G35N, D36T, E59S, K62R, N63D, M66Y, K67E, K70D, K72E, E76R, D77N, K78R, E94L, S96E, T98Q, N101Q, K102Y, K104R, D105E, K116T, P130S, K131E, V132T, E136P, K137R, I148V, E151R, K155Q, N157D, F158N, S190E, S191Y, K193R, K194R, N197E, P200M, G216R, D220Q, K221T, D228S, K229Q, R231E, G232P, E235R, K238S, R239S, E240T, E262L, N287R, D290Q, E297L, K302L, R303E, E307R, K318N, K321R, K324E, R325D, E327R, L328Y, W331L, E343N, E345P, K348E, M349Q, N352R, K353E, E356R, N357H, I364P, K365R, D377E, E380N, K382E, K384R, E389D, K392E, K393A, K396Q, R397E, S403F, N407I |
| 319 | pA15962 | 6 | K5H, K10E, K11H, S21E, E29R, K32I, E33N, K34M, G35H, Y37P, M56W, E59S, K62R, N63D, M66Y, K67E, K70D, E71R, K72T, E76R, D77N, K78L, S96E, N101Q, K104R, D105E, K116D, K131E, V132T, P134A, Y135L, E136P, K137R, E147R, I148E, T152A, Y156M, Q159R, V179I, S190E, S191Y, K193R, K194R, G216R, K221Q, D228S, K229Q, G232P, E262Q, K318D, K321R, D322T, K324E, R325G, E327R, L328Y, E343N, E345P, K348R, M349E, N352R, D373R, K382L, K384R, K392L, K393A, K396M, R397E, E400R, S403A, N407H, L408D |
| 320 | pA15963 | 6 | S4P, K5A, D6H, K10E, K11H, S21E, K32I, K34M, G35H, Y37P, N63R, K67E, K70D, E71R, K72L, E76R, D77N, K78L, E94L, T98Q, N101Q, K102Y, K104R, D105E, K116T, Y135L, E136P, E147R, I148E, K155Q, Y156M, V179I, S190D, S191E, K193R, K194R, K229Q, G232P, E262Q, K318D, K321R, D322T, R325D, L328Y, E343N, E345P, K348R, M349E, N352R, G361D, D363P, I364L, K365S, D373L, K382L, K384E, N385P, D386H, R388E, E389D, K392R, K393A, K396M, R397E, E400R, N407H, L408D |
| 374 | pA16624 | 6 | C17T |
| 375 | pA16625 | 6 | S18N |
| 376 | pA16626 | 6 | S18A |
| 377 | pA16631 | 6 | Q46W |
| 378 | pA16632 | 6 | Q46R |
| 379 | pA16633 | 6 | D84P |
| 380 | pA16634 | 6 | D84A |
| 381 | pA16635 | 6 | L89G |
| 382 | pA16637 | 6 | H45Q |
| 383 | pA16638 | 6 | H45A |
| 384 | pA16639 | 6 | H45K |
| 385 | pA16640 | 6 | Q46A |
| 386 | pA16643 | 6 | D84G |
| 387 | pA16645 | 6 | L89S |
| 388 | pA16647 | 6 | H45F |
| 389 | pA16649 | 6 | Q46S |
| 390 | pA16651 | 6 | Q46T |
| 391 | pA16653 | 6 | Q92A |
| 392 | pA16654 | 6 | Q92M |
| 393 | pA16655 | 6 | Q92P |
| 394 | pA16656 | 6 | Q92D |
| 395 | pA16657 | 6 | S123A |
| 396 | pA16659 | 6 | Q92G |
| 397 | pA16660 | 6 | H119N |
| 398 | pA16663 | 6 | H119G |
| 399 | pA16664 | 6 | H119P |
| 400 | pA16665 | 6 | C122G |
| 401 | pA16668 | 6 | C122E |
| 402 | pA16669 | 6 | C122K |
| 403 | pA16670 | 6 | H119S |
| 404 | pA16671 | 6 | S123M |

TABLE 2-continued

Modified Polypeptides

| SEQ NO. | Plasmid ID | Parent Wild Type SEQ ID NO. | Mutation Position (correspond to SEQ ID NO.: 2) |
|---|---|---|---|
| 405 | pA16672 | 6 | S123R |
| 406 | pA16673 | 6 | S123T |
| 407 | pA16674 | 6 | M124R |
| 408 | pA16675 | 6 | M124K |
| 409 | pA16678 | 6 | T166M |
| 410 | pA16680 | 6 | T166I |
| 411 | pA16682 | 6 | T166L |
| 412 | pA16684 | 6 | D167A |
| 413 | pA16685 | 6 | D167V |
| 414 | pA16686 | 6 | D167T |
| 415 | pA16687 | 6 | D167N |
| 416 | pA16688 | 6 | V168M |
| 417 | pA16689 | 6 | V168R |
| 418 | pA16691 | 6 | I170K |
| 419 | pA16693 | 6 | A171P |
| 420 | pA16694 | 6 | I170T |
| 421 | pA16695 | 6 | I170M |
| 422 | pA16705 | 6 | E175K |
| 423 | pA16706 | 6 | E176Y |
| 424 | pA16707 | 6 | E175V |
| 425 | pA16708 | 6 | E176F |
| 426 | pA16710 | 6 | G173S |
| 427 | pA16712 | 6 | E175R |
| 428 | pA16719 | 6 | G178P |
| 429 | pA16720 | 6 | V210P |
| 430 | pA16722 | 6 | V210T |
| 431 | pA16726 | 6 | M212K |
| 432 | pA16729 | 6 | M212L |
| 433 | pA16730 | 6 | M212R |
| 434 | pA16733 | 6 | T249S |
| 435 | pA16736 | 6 | R339G |
| 436 | pA16737 | 6 | R339A |
| 437 | pA16738 | 6 | R339T |
| 438 | pA16740 | 6 | R339E |
| 439 | pA16741 | 6 | Y340P |
| 440 | pA16742 | 6 | Y340R |
| 441 | pA16743 | 6 | Y340H |
| 442 | pA16744 | 6 | Y53V |
| 443 | pA16745 | 6 | Y53S |
| 444 | pA16746 | 6 | Y53A |

In some embodiments, the polypeptide comprises the amino acid sequence set forth in SEQ ID NO: 1 is derived from *Caldithrix abyssi*. In some embodiments, the polypeptide may have a molecular weight of 50.0 kDa to 52.0 kDa. In some embodiments, the polypeptide comprises the amino acid sequence set forth in SEQ ID NO: 2 is derived from *Anaerolinea thermophila*. In some embodiments, the polypeptide may have a molecular weight of 46.3 kDa to 48.3 kDa. In some embodiments, the polypeptide comprises the amino acid sequence set forth in SEQ ID NO: 3 is derived from *Thermoanaerobacterium thermosaccharolyticum*. In some embodiments, the polypeptide may have a molecular weight of 48.4 kDa to 50.4 kDa. In some embodiments, the polypeptide comprises the amino acid sequence set forth in SEQ ID NO: 4 is derived from *Thermoanaerobacter thermohydrosulfuricus*. In some embodiments, the polypeptide may have a molecular weight of 50.0 kDa to 52.0 kDa. In some embodiments, the polypeptide comprises the amino acid sequence set forth in SEQ ID NO: 5 is derived from *Caldicellulosiruptor kronotskyensis*. In some embodiments, the polypeptide may have a molecular weight of 48.3 kDa to 50.3 kDa. In some embodiments, the polypeptide comprises the amino acid sequence set forth in SEQ ID NO: 6 is derived from *Dictyoglomus turgidum*. In some embodiments, the polypeptide may have a molecular weight of 46.9 kDa to 48.9 kDa. In some embodiments, the polypeptide comprises the amino acid sequence set forth in SEQ ID NO: 7 is derived from *Caldilinea aerophila*. In some embodiments, the polypeptide may have a molecular weight of 44.7 kDa to 46.7 kDa. In some embodiments, the polypeptide comprises the amino acid sequence set forth in SEQ ID NO: 8 is derived from *Rhodothermus marinus*. In some embodiments, the polypeptide may have a molecular weight of 45.9 kDa to 47.9 kDa. In some embodiments, the polypeptide comprises the amino acid sequence set forth in SEQ ID NO: 9 is derived from *Methanohalobium evestigatum*. In some embodiments, the polypeptide may have a molecular weight of 44.7 kDa to 46.7 kDa. In some embodiments, the polypeptide comprises the amino acid sequence set forth in SEQ ID NO: 10 is derived from *Thermoanaerobacter thermohydrosulfuricus*. In some embodiments, the polypeptide may have a molecular weight of 37.6 kDa to 39.6 kDa. In some embodiments, the polypeptide comprises the amino acid sequence set forth in SEQ ID NO: 11 is derived from *Clostridium cavendishii*. In some embodiments, the polypeptide may have a molecular weight of 48.7 kDa to 50.7 kDa. In some embodiments, the polypeptide comprises the amino acid sequence set forth in SEQ ID NO: 12 is derived from *Kosmotoga olearia*. In some embodiments, the polypeptide may have a molecular weight of 48.3 kDa to 50.3 kDa. In some embodiments, the polypeptide comprises the amino acid sequence set forth in SEQ ID NO: 13 is derived from *Butyricicoccus pullicaecorum*. In some embodiments, the polypeptide may have a molecular weight of 48.0 kDa to 50.0 kDa. In some embodiments, the polypeptide comprises the amino acid sequence set forth in SEQ ID NO: 14 is derived from *Clostridium thermobutyricum*. In some embodiments, the polypeptide may have a molecular weight of 50.6 kDa to 52.6 kDa. In some embodiments, the polypeptide comprises the amino acid sequence set forth in SEQ ID NO: 15 is derived from *Litorilinea aerophila*. In some embodiments, the polypeptide may have a molecular weight of 46.5 kDa to 48.5 kDa. In some embodiments, the polypeptide comprises the amino acid sequence set forth in SEQ ID NO: 16 is derived from *Enterobacter mori*. In some embodiments, the polypeptide may have a molecular weight of 47.5 kDa to 49.5 kDa. In some embodiments, the polypeptide comprises the amino acid sequence set forth in SEQ ID NO: 17 is derived from *Caldisericum exile*. In some embodiments, the polypeptide may have a molecular weight of 47.1 kDa to 49.1 kDa. In some embodiments, the polypeptide comprises the amino acid sequence set forth in SEQ ID NO: 18 is derived from *Dictyoglomus thermophilum*. In some embodiments, the polypeptide may have a molecular weight of 46.9 kDa to 48.9 kDa. In some embodiments, the polypeptide comprises the amino acid sequence set forth in SEQ ID NO: 19 is derived from *Rhodothermus marinus*. In some embodiments, the polypeptide may have a molecular weight of 45.9 kDa to 47.9 kDa. In some embodiments, the polypeptide comprises the amino acid sequence set forth in SEQ ID NO: 20 is derived from *Rhodothermus profundi*. In some embodiments, the polypeptide may have a molecular weight of 46.3 kDa to 48.3 kDa. In some embodiments, the polypeptide comprises the amino acid sequence set forth in SEQ ID NO: 21 is derived from *Caldibacillus debilis*. In some embodiments, the polypeptide may have a molecular weight of 47.5 kDa to 49.5 kDa. In some embodiments, the polypeptide comprises the amino acid sequence set forth in SEQ ID NO: 22 is derived from *Caloramator quimbayensis*. In some embodiments, the polypeptide may have a molecular weight of 46.8 kDa to 48.8 kDa. In some embodiments, the polypeptide comprises the amino acid sequence set forth in SEQ ID NO: 23 is derived from *Methanosalsum zhilinae*. In some embodiments, the polypeptide may have a molecular weight of 41.6 kDa to 43.6 kDa. In some embodiments, the polypeptide comprises the amino acid sequence set forth in SEQ ID NO: 321 is derived from *Pseudothermotoga thermarum*. In some embodiments, the polypeptide may have a molecular weight of 56.2 kDa to 58.2 kDa. In some embodiments, the polypeptide comprises the amino acid sequence set forth in SEQ ID NO: 322 is derived from *Pseudothermotoga hypogea*. In some embodiments, the polypeptide may have a molecular weight of 54.8 kDa to 56.8 kDa. In some embodiments, the polypeptide comprises the amino acid sequence set forth in SEQ ID NO: 323 is derived from *Pseudothermotoga lettingae*. In some embodiments, the polypeptide may have a molecular weight of 55.9 kDa to 57.9 kDa. In some embodiments, the polypeptide comprises the amino acid sequence set forth in SEQ ID NO: 324 is derived from *Rhodothermus marinus*. In some embodiments, the polypeptide may have a molecular weight of 57.5 kDa to 59.5 kDa. In some embodiments, the polypeptide comprises the amino acid sequence set forth in SEQ ID NO: 325 is derived from *Geosporobacter subterraneus*. In some embodiments, the polypeptide may have a molecular weight of 56.2 kDa to 58.2 kDa. In some embodiments, the polypeptide comprises the amino acid sequence set forth in SEQ ID NO: 326 is derived from *Melioribacter roseus*. In some embodiments, the polypeptide may have a molecular weight of 58.0 kDa to 60.0 kDa. In some embodiments, the polypeptide comprises the amino acid sequence set forth in SEQ ID NO: 327 is derived from *Lysinibacillus sphaericus*. In some embodiments, the polypeptide may have a molecular weight of 55.2 kDa to 57.2 kDa. In some embodiments, the polypeptide comprises the amino acid sequence set forth in SEQ ID NO: 328 is derived from *Clostridium stercorarium*. In some embodiments, the polypeptide may have a molecular weight of 56.9 kDa to 58.9 kDa. In some embodiments, the polypeptide comprises the amino acid sequence set forth in SEQ ID NO: 329 is derived from *Truepera radiovictrix*. In some embodiments, the polypeptide may have a molecular weight of 51.8 kDa to 53.8 kDa. In some embodiments, the polypeptide comprises the amino acid sequence set forth in SEQ ID NO: 330 is derived from *Dictyoglomus turgidum*. In some embodiments, the polypeptide may have a molecular weight of 55.7 kDa to 57.7 kDa. In some embodiments, the polypeptide comprises the amino acid sequence set forth in SEQ ID NO: 331 is derived from *Caldilinea aerophila*. In some embodiments, the polypeptide may have a molecular weight of 51.0 kDa to 53.0 kDa. In some embodiments, the polypeptide comprises the amino acid sequence set forth in SEQ ID NO: 332 is derived from *Thermoflexus hugenholtzii*. In some embodiments, the polypeptide may have a molecular weight of 51.5 kDa to 53.5 kDa. In some embodiments, the polypeptide comprises the amino acid sequence set forth in SEQ ID NO: 333 is derived from *Thermoanaerobacterium thermosaccharolyticum*. In some embodiments, the polypeptide may have a molecular weight of 54.7 kDa to 56.7 kDa. In some embodiments, the polypeptide comprises the amino acid sequence set forth in SEQ ID NO: 334 is derived from *Petrotoga mobilis*. In some embodiments, the polypeptide may have a molecular weight of 43.8 kDa to 45.8 kDa. In some embodiments, the polypeptide comprises the amino acid sequence set forth in SEQ ID NO: 335 is derived from *Spirochaeta thermophila*. In some embodiments, the polypeptide may have a molecular weight of 46.2 kDa to 48.2 kDa. In some embodiments, the polypeptide comprises the amino acid sequence set forth in SEQ ID NO: 336 is derived from *Thermofilum pendens*. In some embodiments, the polypeptide may have a molecular weight of 53.4 kDa to 55.4 kDa. In some embodiments, the polypeptide comprises the amino acid sequence set forth in SEQ ID NO: 337 is derived from *Rhodothermus marinus*. In some embodiments, the polypeptide may have a molecular weight of 57.3 kDa to 59.3 kDa. In some embodiments, the polypeptide comprises the amino acid sequence set forth in SEQ ID NO: 338 is derived from *Dictyoglomus thermophilum*. In some embodiments, the polypeptide may have a molecular weight of 55.9 kDa to 57.9 kDa. In some embodiments, the polypeptide comprises the amino acid sequence set forth in SEQ ID NO: 339 is derived from *Thermoanaerobacter siderophilus*. In some embodiments, the polypeptide may have a molecular weight of 55.0 kDa to 57.0 kDa. In some embodiments, the polypeptide comprises the amino acid sequence set forth in SEQ ID NO: 340 is derived from *Thermoanaerobacter mathranii*. In some embodiments, the polypeptide may have a molecular weight of 54.8 kDa to 56.8 kDa. In some embodiments, the polypeptide comprises the amino acid sequence set forth in SEQ ID NO: 341 is derived from *Thermoanaerobacter italicus*. In some embodiments, the polypeptide may have a molecular weight of 54.9 kDa to 56.9 kDa. In some embodiments, the polypeptide comprises the amino acid sequence set forth in SEQ ID NO: 342 is derived from *Thermoanaerobacterium thermosaccharolyticum*. In some embodiments, the polypeptide may have a molecular weight of 54.7 kDa to 56.7 kDa. In some embodiments, the polypeptide comprises the amino acid sequence set forth in SEQ ID NO: 343 is derived from *Thermoanaerobacterium thermosaccharolyticum*. In some embodiments, the polypeptide may have a molecular weight of 54.7 kDa to 56.7 kDa. In some embodiments, the polypeptide comprises the amino acid sequence set forth in SEQ ID NO: 344 is derived from *Thermoanaerobacterium thermosaccharolyticum*. In some embodiments, the polypeptide may have a molecular weight of 54.6 kDa to 56.6 kDa. In some embodiments, the polypeptide comprises the amino acid sequence set forth in SEQ ID NO: 345 is derived from *Thermoanaerobacterium thermosaccharolyticum*. In some embodiments, the polypeptide may have a molecular weight of 54.5 kDa to 56.5 kDa. In some embodiments, the polypeptide comprises the amino acid sequence set forth in SEQ ID NO: 346 is derived from *Thermoanaerobacterium xylanolyticum*. In some embodiments, the polypeptide may have a molecular weight of 54.2 kDa to 56.2 kDa. In some embodiments, the polypeptide comprises the amino acid sequence set forth in SEQ ID NO: 347 is derived from *Petrotoga mobilis*. In some embodiments, the polypeptide may have a molecular weight of 43.9 kDa to 45.9 kDa. In some embodiments, the polypeptide comprises the amino acid sequence set forth in SEQ ID NO: 348 is derived from *Thermoanaerobacterium saccharolyticum*. In some embodiments, the polypeptide may have a molecular weight of 54.0 kDa to 56.0 kDa. In some embodiments, the polypeptide comprises the amino acid sequence set forth in SEQ ID NO: 349 is derived from *Petrotoga mobilis*. In some embodiments, the polypeptide may have a molecular weight of 44.4 kDa to 46.4 kDa. In some embodiments, the polypeptide comprises the amino acid sequence set forth in SEQ ID NO: 350 is derived from *Spirochaeta thermophila*. In some embodiments, the polypeptide may have a molecular weight of 46.5 kDa to 48.5 kDa. In some embodiments, the polypeptide comprises the amino acid sequence set forth in SEQ ID NO: 351 is derived from *Ignisphaera aggregans*. In some embodiments, the polypeptide may have a molecular weight of 29.1 kDa to 31.1 kDa. In some embodiments, the polypeptide comprises the amino acid sequence set forth in SEQ ID NO: 352 is derived from *Thermotoga maritima*. In some embodiments, the polypeptide may have a molecular weight of 54.6 kDa to 56.6 kDa. In some embodiments, the polypeptide comprises the amino acid sequence set forth in SEQ ID NO: 353 is derived from *Caldanaerobacter subterraneus*. In some embodiments, the polypeptide may have a molecular weight of 55.2 kDa to 57.2 kDa. In some embodiments, the polypeptide comprises the amino acid sequence set forth in SEQ ID NO: 354 is derived from *Mesotoga infera*. In some embodiments, the polypeptide may have a molecular weight of 57.1 kDa to 59.1 kDa. In some embodiments, the polypeptide comprises the amino acid sequence set forth in SEQ ID NO: 355 is derived from *Thermosinus carboxydivorans*. In some embodiments, the polypeptide may have a molecular weight of 54.5 kDa to 56.5 kDa. In some embodiments, the polypeptide comprises the amino acid sequence set forth in SEQ ID NO: 356 is derived from *Halanaerobium congolense*. In some embodiments, the polypeptide may have a molecular weight of 57.5 kDa to 59.5 kDa. In some embodiments, the polypeptide comprises the amino acid sequence set forth in SEQ ID NO: 357 is derived from *Halanaerobium congolense*. In some embodiments, the polypeptide may have a molecular weight of 57.5 kDa to 59.5 kDa. In some embodiments, the polypeptide comprises the amino acid sequence set forth in SEQ ID NO: 358 is derived from *Halanaerobium saccharolyticum*. In some embodiments, the polypeptide may have a molecular weight of 57.2 kDa to 59.2 kDa. In some embodiments, the polypeptide comprises the amino acid sequence set forth in SEQ ID NO: 359 is derived from *Gracilibacillus halophilus*. In some embodiments, the polypeptide may have a molecular weight of 56.1 kDa to 58.1 kDa. In some embodiments, the polypeptide comprises the amino acid sequence set forth in SEQ ID NO: 360 is derived from *Caldanaerobacter subterraneus*. In some embodiments, the polypeptide may have a molecular weight of 55.6 kDa to 57.6 kDa. In some embodiments, the polypeptide comprises the amino acid sequence set forth in SEQ ID NO: 361 is derived from *Litorilinea aerophila*. In some embodiments, the polypeptide may have a molecular weight of 45.2 kDa to 47.2 kDa. In some embodiments, the polypeptide comprises the amino acid sequence set forth in SEQ ID NO: 362 is derived from *Caldanaerobacter subterraneus*. In some embodiments, the polypeptide may have a molecular weight of 55.4 kDa to 57.4 kDa. In some embodiments, the polypeptide comprises the amino acid sequence set forth in SEQ ID NO: 363 is derived from *Caldanaerobacter subterraneus*. In some embodiments, the polypeptide may have a molecular weight of 56.3 kDa to 58.3 kDa. In some embodiments, the polypeptide comprises the amino acid sequence set forth in SEQ ID NO: 364 is derived from *Caldicoprobacter faecalis*. In some embodiments, the polypeptide may have a molecular weight of 54.4 kDa to 56.4 kDa. In some embodiments, the polypeptide comprises the amino acid sequence set forth in SEQ ID NO: 365 is derived from *Thermoanaerobacter uzonensis*. In some embodiments, the polypeptide may have a molecular weight of 55.2 kDa to 57.2 kDa. In some embodiments, the polypeptide comprises the amino acid sequence set forth in SEQ ID NO: 366 is derived from *Lactobacillus ingluviei*. In some embodiments, the polypeptide may have a molecular weight of 60.1 kDa to 62.1 kDa. In some embodiments, the polypeptide comprises the amino acid sequence set forth in SEQ ID NO: 367 is derived from *Petrotoga mexicana*. In some embodiments, the polypeptide may have a molecular weight of 44.4 kDa to 46.4 kDa. In some embodiments, the polypeptide comprises the amino acid sequence set forth in SEQ ID NO: 368 is derived from *Defluviitoga tunisiensis*. In some embodiments, the polypeptide may have a molecular weight of 44.0 kDa to 46.0 kDa. In some embodiments, the polypeptide comprises the amino acid sequence set forth in SEQ ID NO: 369 is derived from *Petrotoga miotherma*. In some embodiments, the polypeptide may have a molecular weight of 43.8 kDa to 45.8 kDa. In some embodiments, the polypeptide comprises the amino acid sequence set forth in SEQ ID NO: 370 is derived from *Petrotoga olearia*. In some embodiments, the polypeptide may have a molecular weight of 43.7 kDa to 45.7 kDa. In some embodiments, the polypeptide comprises the amino acid sequence set forth in SEQ ID NO: 371 is derived from *Thermophagus xiamenensis*. In some embodiments, the polypeptide may have a molecular weight of 46.4 kDa to 48.4 kDa. In some embodiments, the polypeptide comprises the amino acid sequence set forth in SEQ ID NO: 372 is derived from *Treponema caldarium*. In some embodiments, the polypeptide may have a molecular weight of 45.9 kDa to 47.9 kDa. In some embodiments, the polypeptide comprises the amino acid sequence set forth in SEQ ID NO: 373 is derived from *Thermofilum uzonense*. In some embodiments, the polypeptide may have a molecular weight of 52.9 kDa to 54.9 kDa.

Polypeptides having D-fructose C4-epimerase activity according to the disclosure can be provided by means of recombinant DNA technology methods allowing it to be produced by cultivating in a culturing medium an appropriate host organism cell comprising a gene coding for the D-fructose C4-epimerase, and recovering the enzyme from the cells and/or the culturing medium. Examples of host cells for transformation include *Escherichia. coli*, (hereinafter referred to as *E. coli*), *Corynebacterum glutamicum*, *Aspergillus oryzae*, *Pichia pastoris*, or *Bacillus subtilis*, and the like. Examples of transformed *E. coli* microorganisms may include *E. coli* NEBT7EL-pA06233, NEBT7EL-pA06234, NEBT7EL-pA06235, NEBT7EL-pA06236, NEBT7EL-pA06237, NEBT7EL-pA06238, NEBT7EL-pA06239, NEBT7EL-pA06240, NEBT7EL-pA06241, NEBT7EL-pA07068, NEBT7EL-pA07069, NEBT7EL-pA07070, NEBT7EL-pA07071, NEBT7EL-pA07072, NEBT7EL-pA07073, NEBT7EL-pA07074, NEBT7EL-pA07075, NEBT7EL-pA07076, NEBT7EL-pA07077, NEBT7EL-pA07078, NEBT7EL-pA07079, NEBT7EL-pA07080, NEBT7EL-pA07081, NEBT7EL-pA06242, NEBT7EL-pA06243, NEBT7EL-pA06246, NEBT7EL-pA06247, NEBT7EL-pA06248, NEBT7EL-pA06249, NEBT7EL-pA06250, NEBT7EL-pA06252, NEBT7EL-pA06253, NEBT7EL-pA06254, NEBT7EL-pA06255, NEBT7EL-pA06256, NEBT7EL-pA06257, NEBT7EL-pA06261, NEBT7EL-pA06265, NEBT7EL-pA06266, NEBT7EL-pA06267, NEBT7EL-pA06268, NEBT7EL-pA06270, NEBT7EL-pA06271, NEBT7EL-pA06272, NEBT7EL-pA06273, NEBT7EL-pA06274, NEBT7EL-pA07082, NEBT7EL-pA07083, NEBT7EL-pA07084, NEBT7EL-pA07085, NEBT7EL-pA07086, NEBT7EL-pA07087, NEBT7EL-pA07088, NEBT7EL-pA07089, NEBT7EL-pA07090, NEBT7EL-pA07091, NEBT7EL-pA07092, NEBT7EL-pA07094, NEBT7EL-pA07095, NEBT7EL-pA07096, NEBT7EL-pA07097, NEBT7EL-pA07098, NEBT7EL-pA07099, NEBT7EL-pA07100, and NEB T7EL-pA07101.

In some embodiments, the polypeptide comprises the amino acid sequence set forth in SEQ ID NO: 1. In some embodiments, the polypeptide comprises the amino acid sequence set forth in SEQ ID NO: 2. In some embodiments, the polypeptide comprises the amino acid sequence set forth in SEQ ID NO: 3. In some embodiments, the polypeptide comprises the amino acid sequence set forth in SEQ ID NO: 4. In some embodiments, the polypeptide comprises the amino acid sequence set forth in SEQ ID NO: 5. In some embodiments, the polypeptide comprises the amino acid sequence set forth in SEQ ID NO: 6. In some embodiments, the polypeptide comprises the amino acid sequence set forth in SEQ ID NO: 7. In some embodiments, the polypeptide comprises the amino acid sequence set forth in SEQ ID NO: 8. In some embodiments, the polypeptide comprises the amino acid sequence set forth in SEQ ID NO: 9. In some embodiments, the polypeptide comprises the amino acid sequence set forth in SEQ ID NO: 10. In some embodiments, the polypeptide comprises the amino acid sequence set forth in SEQ ID NO: 11. In some embodiments, the polypeptide comprises the amino acid sequence set forth in SEQ ID NO: 12. In some embodiments, the polypeptide comprises the amino acid sequence set forth in SEQ ID NO: 13. In some embodiments, the polypeptide comprises the amino acid sequence set forth in SEQ ID NO: 14. In some embodiments, the polypeptide comprises the amino acid sequence set forth in SEQ ID NO: 15. In some embodiments, the polypeptide comprises the amino acid sequence set forth in SEQ ID NO: 16. In some embodiments, the polypeptide comprises the amino acid sequence set forth in SEQ ID NO: 17. In some embodiments, the polypeptide comprises the amino acid sequence set forth in SEQ ID NO: 18. In some embodiments, the polypeptide comprises the amino acid sequence set forth in SEQ ID NO: 19. In some embodiments, the polypeptide comprises the amino acid sequence set forth in SEQ ID NO: 20. In some embodiments, the polypeptide comprises the amino acid sequence set forth in SEQ ID NO: 21. In some embodiments, the polypeptide comprises the amino acid sequence set forth in SEQ ID NO: 22. In some embodiments, the polypeptide comprises the amino acid sequence set forth in SEQ ID NO: 23. In some embodiments, the polypeptide comprises the amino acid sequence set forth in SEQ ID NO: 321. In some embodiments, the polypeptide comprises the amino acid sequence set forth in SEQ ID NO: 322. In some embodiments, the polypeptide comprises the amino acid sequence set forth in SEQ ID NO: 323. In some embodiments, the polypeptide comprises the amino acid sequence set forth in SEQ ID NO: 324. In some embodiments, the polypeptide comprises the amino acid sequence set forth in SEQ ID NO: 325. In some embodiments, the polypeptide comprises the amino acid sequence set forth in SEQ ID NO: 326. In some embodiments, the polypeptide comprises the amino acid sequence set forth in SEQ ID NO: 327. In some embodiments, the polypeptide comprises the amino acid sequence set forth in SEQ ID NO: 328. In some embodiments, the polypeptide comprises the amino acid sequence set forth in SEQ ID NO: 329. In some embodiments, the polypeptide comprises the amino acid sequence set forth in SEQ ID NO: 330. In some embodiments, the polypeptide comprises the amino acid sequence set forth in SEQ ID NO: 331. In some embodiments, the polypeptide comprises the amino acid sequence set forth in SEQ ID NO: 332. In some embodiments, the polypeptide comprises the amino acid sequence set forth in SEQ ID NO: 333. In some embodiments, the polypeptide comprises the amino acid sequence set forth in SEQ ID NO: 334. In some embodiments, the polypeptide comprises the amino acid sequence set forth in SEQ ID NO: 335. In some embodiments, the polypeptide comprises the amino acid sequence set forth in SEQ ID NO: 336. In some embodiments, the polypeptide comprises the amino acid sequence set forth in SEQ ID NO: 337. In some embodiments, the polypeptide comprises the amino acid sequence set forth in SEQ ID NO: 338. In some embodiments, the polypeptide comprises the amino acid sequence set forth in SEQ ID NO: 339. In some embodiments, the polypeptide comprises the amino acid sequence set forth in SEQ ID NO: 340. In some embodiments, the polypeptide comprises the amino acid sequence set forth in SEQ ID NO: 341. In some embodiments, the polypeptide comprises the amino acid sequence set forth in SEQ ID NO: 342. In some embodiments, the polypeptide comprises the amino acid sequence set forth in SEQ ID NO: 343. In some embodiments, the polypeptide comprises the amino acid sequence set forth in SEQ ID NO: 344. In some embodiments, the polypeptide comprises the amino acid sequence set forth in SEQ ID NO: 345. In some embodiments, the polypeptide comprises the amino acid sequence set forth in SEQ ID NO: 346. In some embodiments, the polypeptide comprises the amino acid sequence set forth in SEQ ID NO: 347. In some embodiments, the polypeptide comprises the amino acid sequence set forth in SEQ ID NO: 348. In some embodiments, the polypeptide comprises the amino acid sequence set forth in SEQ ID NO: 349. In some embodiments, the polypeptide comprises the amino acid sequence set forth in SEQ ID NO: 350. In some embodiments, the polypeptide comprises the amino acid sequence set forth in SEQ ID NO:

351. In some embodiments, the polypeptide comprises the amino acid sequence set forth in SEQ ID NO: 352. In some embodiments, the polypeptide comprises the amino acid sequence set forth in SEQ ID NO: 353. In some embodiments, the polypeptide comprises the amino acid sequence set forth in SEQ ID NO: 354. In some embodiments, the polypeptide comprises the amino acid sequence set forth in SEQ ID NO: 355. In some embodiments, the polypeptide comprises the amino acid sequence set forth in SEQ ID NO: 356. In some embodiments, the polypeptide comprises the amino acid sequence set forth in SEQ ID NO: 357. In some embodiments, the polypeptide comprises the amino acid sequence set forth in SEQ ID NO: 358. In some embodiments, the polypeptide comprises the amino acid sequence set forth in SEQ ID NO: 359. In some embodiments, the polypeptide comprises the amino acid sequence set forth in SEQ ID NO: 360. In some embodiments, the polypeptide comprises the amino acid sequence set forth in SEQ ID NO: 361. In some embodiments, the polypeptide comprises the amino acid sequence set forth in SEQ ID NO: 362. In some embodiments, the polypeptide comprises the amino acid sequence set forth in SEQ ID NO: 363. In some embodiments, the polypeptide comprises the amino acid sequence set forth in SEQ ID NO: 364. In some embodiments, the polypeptide comprises the amino acid sequence set forth in SEQ ID NO: 365. In some embodiments, the polypeptide comprises the amino acid sequence set forth in SEQ ID NO: 366. In some embodiments, the polypeptide comprises the amino acid sequence set forth in SEQ ID NO: 367. In some embodiments, the polypeptide comprises the amino acid sequence set forth in SEQ ID NO: 368. In some embodiments, the polypeptide comprises the amino acid sequence set forth in SEQ ID NO: 369. In some embodiments, the polypeptide comprises the amino acid sequence set forth in SEQ ID NO: 370. In some embodiments, the polypeptide comprises the amino acid sequence set forth in SEQ ID NO: 371. In some embodiments, the polypeptide comprises the amino acid sequence set forth in SEQ ID NO: 372. In some embodiments, the polypeptide comprises the amino acid sequence set forth in SEQ ID NO: 373.

TABLE 3

Native Sequences

| SEQ NO. | Plasmid ID | Sequence | Organism |
|---|---|---|---|
| 1 | pA06233 | MSLHPLNKLIERHKKGTPVGIYSVCSANPFVL KAAMLQAQKDQSLLLIEATSNQVDQFGGYTG MRPEDFKTMTLELAAENNYDPQGLILGGDHL GPNRWTKLSASRAMDYAREQIAAYVKAGFSK IHLDATMPLQNDATDSAGRLPVETIAQRTAEL CAVAEQTYRQSDQLFPPPVYIVGSDVPIPGGA QEALNQIHITEVKEVQQTIDHVRRAFEKNGLE AAYERVCAVVVQPGVEFADQIVFEYAPDRAA ALKDFIESHSQLVYEAHSTDYQTAPLLRQMVK DHFAILKVGPALTFALREAIFALAFMEKELLPL HRALKPSAILETLDQTMDKNPAYWQKHYGGT KEEVRFAQRFSLSDRIRYYWPFPKVQKALRQL LKNLQQISIPLTLVSQFMPEEYQRIRQGTLTND PQALILNKIQSVLKQYAEATQIQNSLTFTQNQN SLAMERL | *Caldithrix abyssi* |
| 2 | pA06234 | MMFGSPAPLLDMVTAQKQGMARGIPSICSAH PVVLSAACHLARRSGAPLLIETTCNQVNHQGG YSGMTPADFVRFLREILEREGIPPQQVILGGDH LGPYPWRKEPAETAIAQALEMVRAYVQAGYT KIHLDASMPCADDDPERPLPLERIARRAAQLC AAAEAAAGAVQPVYVIGSEVPPPGGAQGQEA RLHVTTPQEAQAALDAFREAFLQAGLTPVWE RVIALVVQPGVEFGVDSIHAYQREAARPLKTFI EGVPGMVYEAHSTDYQTRASLRALVEDHFSIL KVGPALTFAYREAVFALEHIEREILGRQDMPLS RLSEVLDEVMLNDPRHWQGYFAGAPAEQALA RRYSFSDRIRYYWHHPAAQEAVRRLLANLIET PPPLSLLSQYLPREYEMVRAGEISSHPQDLIRA HIQHTLEDYAAACG | *Anaerolinea thermophila* |
| 3 | pA06235 | MAKEHPLKELVNKQKSGISEGIVSICSSNEFVIE ASMERALTNGDYVLIESTANQVNQYGGYIGM TPIEFKKFVFSIAKKVDFPLDKLILGGDHLGPLI WKNESSNLALAKASELIKEYVLAGYTKIHIDTS MRLKDDTDFNTEIIAQRSAVLLKAAENAYMEL NKNNKNVLHPVYVIGSEVPIPGGSQGSDESLQI TDAKDFENTVEIFKDVFSKYGLINEWENIVAF VVQPGVEFGNDFVHEYKRDEAKELTDALKNY KTFVFEGHSTDYQTRESLKQMVEDGIAILKVG PALTFALREALIALNNIENELLNNVDSIKLSNFT NVLVSEMINNPEHWKNHYFGDDARKKFLCKY SYSDRCRYYLPTRNVKNSLNLLIRNLENVKIP MTLISQFMPLQYDNIRRGLIKNEPISLIKNAIMN RLNDYYYAIKP | *Thermoanaerobacterium thermosaccharolyticum* |
| 4 | pA06236 | MNTEHPLKNVVKLQKKGIPIGIYSVCSANEIVI QVAMEKALSMDSYVLIEATANQVNQYGGYT NMKPIDFRDFVYSIAKRINFPENRIILGGDHLGP | *Thermoanaerobacter thermohydrosulfuricus* |

TABLE 3-continued

Native Sequences

| SEQ NO. | Plasmid ID | Sequence | Organism |
|---|---|---|---|
| | | LPWKNQQAKKAMEEAKELVKQFVMAGFTKI HVDTSMLLGDDNINIKLDTETIAERGAILVSVA ERAFEELKKFNPYALHPVYVIGSEVPVPGGSQ KENNNEIQVTKPTDFEETVEVYKSTFYKYGLG NAWEDVVAVVVQAGVEFGVEDIHEYDHQQA ENLVSALKKYPNLVFEAHSTDYQPAKLLKEM VRDGFAILKVGPELTFALREGLFALNIIEKELFK DNHDIEMSNFIDILDTAMLNNPKYWEQYYYG DDNKIRIARKYSYSDRCRYYLIENEVRASMSR LFKNLTNVEIPLTLISQYMPIQYEKIRMGLLKN DPENLVKDKIGNCIDKYLYATNPTSGEFKLI | |
| 5 | pA06237 | MSPQNPLIGLFKNREKEFKGIISVCSSNEIVLEA VLKRMKDTNLPIIIEATANQVNQFGGYSGLTPS QFKERVIKIAQKVDFPLERIILGGDHLGPFVWR DQEPEIAMEYAKQMIKEYIKAGFTKIHIDTSMP LKGENSIDDEIIAKRTAVLCRIAEECFEKISINNP YITRPVYVIGADVPPPGGESSICQTITTKDELER SLEYFKEAFKKEGIEHVFDYVVAVVANFGVEF GSDEIVDFDMEKVKPLKELLAKYNIVFEGHST DYQTKENLKRMVECGIAILKVGPALTFTLREA LVALSHIEEEIYSNEKEKLSRFREVLLNTMLTC KDHWSKYFDENDKLIKSKLLYSYLDRWRYYF ENESVKSAVYSLIGNLENVKIPPWLVSQYFPSQ YQKMRKKDLKNGAADLILDKIGEVIDHYVYA VKE | Caldicellulosiruptor kronotskyensis |
| 6 | pA06238 | MWLSKDYLRKKGVYSICSSNSYVIEASIEFAKE KGDYILIEATPHQVNQFGGYSGMTPEDFKNFV MKIAKEKGLEEDKIILGGDHLGPLPWQDEPSPT AMNKAKDLIRAFVESGYKKIHIDCSMPLSDDP KVLPYEKIAERTRELFEIAEETARKYNFQPVYV VGTDVPIAGGGEEEGVTSVEDFRSAISSLKKYF NDVPNIWDRVVGFVIMLGIGFSYDKVFEYDRD KVRGILEEVKREDLFVEGHSTDYQARYALRN MVEDGVRILKVGPALTAAFRRGVFLLSNIEDEI IPERERSNIKRVILETMLRDDRYWRKYYKDSK RLELDIWYNLLDRIRYYWEYEDVKMVLNKLF ENFSEGVDIKFIYQYFYDSYFDVREGKMKNDP RELIKKEIKRVLEDYSYAINL | Dictyoglomus turgidum |
| 7 | pA06239 | MSTLRHIILRLIELREREQIHLTLLAVCPNSAAV LEAAVKVAARCHTPMLFAATLNQVDRDGGY TGWTPAQFVAEMRRYAVRYGCTTPLYPCLDH GGPWLKDRHAQEKLPLDQAMHEVKLSLTACL EAGYALLHIDPTVDRTLPPGEAPLVPIVVERTV ELIEHAEQERQRLNLPAVAYEVGTEEVHGGLV NFDNFVAFLDLLKARLEQRALMHAWPAFVVA QVGTDLHTTYFDPSAAQRLTEIVRPTGALLKG HYTDWVENPADYPRVGMGGANVGPEFTAAE FEALEALERREQRLCANRKLQPACFLAALEEA VVASDRWRKWLQPDEIGKPFAELTPARRRWL VQTGARYVWTAPKVIAAREQLYAHLSLVQAD PHAYVVESVARSIERYIDAFNLYDAATLLG | Caldilinea aerophila |
| 8 | pA06240 | MQAQALLTVPFDRVATHARGFVGWVAELLQ GPLAYQHTLLAVCPNSEAVTRAALEAAAEAN APLLFAATLNQVDLDGGYTGWTPATLARFVA DELARLDLHIPVVLGLDHGGPWKKDLHARNR LSFEETFQAVLRAIEACLDAGYGLLHLDPTVD LELSPGTPVPIPRIVERSVALLRHAETYRLRRNL PPVAYEVGTEEVGGGLQAEARMAEFLDRLWT ALDREGLPHPVFVVGDIGTRLDTRTFDFERAR RLDALVRRYGALIKGHYTDDVDRLDLYPKAG IGGANVGPLAAIEFEALEALVEEARRRGLSV TFDQAIRRAVVESGRWTKWLQPEEKGQPFDA LDPERQRWLVATGSRYVWTHPAVLQARRELY EALAPWLDADAFVRTRIKARLMDYFRAFNLIH FNERLQAFLPE | Rhodothermus marinus |
| 9 | pA06241 | MTDEDFEPICEISEQFRNYCNQMLESEYDPKPS KYIFNILQNQKTIVMAANPRIGLVTRGILRAAK DADAPIILELARSECNLENGYTGLYPSDFSEQC YQAAKDVGYDIWALHADHIGIKKGDREDIEK TKELVKAQIDAGYTSFAIDASHLFNFQGGDLR | Methanohalobium evestigatum |

TABLE 3-continued

Native Sequences

| SEQ NO. | Plasmid ID | Sequence | Organism |
|---|---|---|---|
| | | EELKDNIDATTEIAKFIEEQMDDREYGLEVEV GEIGREDEHGRVLTNPEEAVTFIKALNENGVY PQVLAIANGSAHGNTYDSQGRLIEQVSIDIPQTI KVAQALKENNLKVRIAQHGITGTPRELIHDHF PHGEIIKGNVGTFYMNLVWDAFKLFEPELYND IWNWTVENYKQKSPDKTDSEIFGKYSKFAIKQ FFDRIYSVNEDTKRAIDAMAYAETLYFLKSFN AERTASIVRDGIK | |
| 10 | pA07068 | MNTEHPLKNVVKLQKKGIPIGIYSVCSANEIVI QVAMEKALSMDSYVLIEATANQVNQYGGYT NMKPIDFRDFVYSIAKRINFPENRIILGGDHLGP LPWKNQQAKKAMEEAKELVKQFVMAGFTKI HVDTSMFLGDDNINIKLDTETIAERGAILVSVA ERAFEELKKSNPYALHPVYVIGSEVPVPGGSQ KENNNEIQVTKPADFEETVEVYKSTFYKYGLG NAWEDVVAVVVQPGVEFGVENIHEYDHQQA ENLVSALKKYPNLVFEAHSTDYQPAKLLKEM VRDGFAILKVGPELTFALREGLFALNIIEKELFK DNHDIEMSNFIDILDTAMLNNPKY | Thermoanaerobacter thermohydrosulfuricus |
| 11 | pA07069 | MQRNYLLDIVEAQNNGIHKGIYSACSANEYVI EAAMERAKNTNEYVLIEATANQVNQYGGYTG MKPIDFKNFVYDIADKINFDKDKIILGGDHLGP LTWSKETEKEAMAKSHELVKEYVMAGFTKIH LDTSMYLADDDRSKKLATEVIARRGAELCKT AEESFKALKERNSMAVAPVYIVGSEVPIPGGIQ DEEEGIQVTKPEDFLETVKVYKAEFKDKGIDE VWNRVIGVVVQPGVEFGDESVHEYNREKAEK LVNSLRGVKGIVFEGHSTDYQTKTKLKEMVE DGIAILKVGPALTYGLREALFALNHIENEIFKY RADIKLSNFINVLETSMVEEPTHWKQHYHGDA EDIKYAMRYSYSDRCRYYMPTEAVNKAMNIL IENLESVEIPLTIIDQYMPMQYKKIREGLIQNKP KELIKDRIGDYIDDYLYALR | Clostridium cavendishii |
| 12 | pA07070 | MKKHPLQDIVSLQKQGIPKGVFSVCSANRFVIE TTLEYAKMKGTTVLIEATCNQVNQFGGYTGM TPADFREMVFSIAEDIGLPKNKIILGGDHLGPN PWKGQPSDQAMRNAIEMIREYAKAGFTKLHL DASMRLADDPGNENEPLNPEVIAERTALLCLE AERAFKESAGSLRPVYVIGTDVPPPGGAQNEG KSIHVTSVQDFERTVELTKKAFFDHGLYEAWG RVIAVVVQPGVEFGNEHIFEYDRNRARELTEAI KKHPNIVFEGHSTDYQTAKALKEMVEDGVAIL KVGPALTFALREAFFALSSIEKELFYDTPGLCS NFVEVVERAMLDNPKHWEKYYQEERENRL ARKYSFLDRLRYYWNLPEVRTAVNKLITNLET KEIPLTLISQFMPMQYKIRNGLLRKDPISLIKD RITLVLDDYYFATHPEC | Kosmotoga olearia |
| 13 | pA07071 | MNHNPLKKIVELQKQGKNVGIYSVCSANGYVI EAALKRGKSDGSCVLIESTANQCDQNGGYTG MTPLDFKNFVLGIADKVGFDPKRLFLGGDHLG PLTFAGMDEAQAMENAEELIRHYVGAGFTKIH IDTSMKVASDDPNTRLSDETIAKRGARLARVA QDTYHKLLESDPDAIAPVYIVGSEVPIPGGAVG AVDQGVQVTKVEDFKNTVATFEKAFREQGLD EAWDNVIGVVVQPGVEEKDSGCTEYDREKAK DLMASIQEFPNLVFEGHSTDYQTKIKLRELVED GVGILKVGPALTFAMREGMFALENIEKELIYG TDITPSGFQDALEAEMLKEGKHWRKHYQGTE LELRMKRKYSFSDRCRYYMPTPAVEAAKERLI SNLRTLGIPLNLLSQFMPIQYTKVREGLLVNDP VELVEDRIINTIDEYLYATHQKELL | Butyricicoccus pullicaecorum |
| 14 | pA07072 | MLLKVKEHPIRELVNRYKNGENVGIFSVCTSN EYVIEAAMERVIDKDLDLLIESTANQVNQDGG YTGMQPKDFVNYVYKIADKVNFPKDRIILGGD HLGPLTWTKLVQEEAMEKAKVLIRDYVLAGF TKIHIDTSMPIYDDLEKGVFGDDLIAERAAILC NVAEIAYRELLKTNEDAIHPIYVVGSEVPVPGG VQAEEAEEEIENGIKVTRVEDFKNTVEVFKKK FKEHGVEEAFNYVGVVVQPGVEFSSDTVWK YEREKAKDLSKALKEYDNLVFEAHSTDYQSP | Clostridium thermobutyricum |

TABLE 3-continued

Native Sequences

| SEQ NO. | Plasmid ID | Sequence | Organism |
|---|---|---|---|
| | | KSLREMVLDGFNILKVGPALTFGFREAAFALN KIEEEMFRFRPDIEESRFIQTLDYNMVKHPENW IKHYSGTSENIRFSRMYSLSDRCRYYMPNEEV EYSFNKMINNLDKEEIPTALISQYMHNQYKKV RDGELKPKGLNLLKDFIGEYVDDYIFAVEDK | |
| 15 | pA07073 | MYPVLENILRAQQQGEALGIPSICSAHPFVLEA TFRHALTTGRTVLIESTCNQVNQHGGYTGMTP GDFVAYVAALADRLHFPRERILLGGDHLGPNP WRDRPADQALNQARILVQEYVRAGYGKIHLD ASMACGGDPADAPLDKAVAAERAAALAEAA EAAFQRMGSGTPPCYVIGTEVPPPGGAQGDD MPLAITAPREVAETIELTQAAFRRRGLEAAWE RVIAVVVQPGVEFGDEQVHPYDRAAAAGLAR AIEPYGRLVYEAHSTDYQTRQALRDLVADHF AILKVGPALTFAFREAVFALAAVEEEWLAGQA GVVLSRLREELEAAMIQDPTHWRGYYRGDER HQRLARRYSYSDRARYYWPRPSVQAALERLL HNLEAAPPPLTLLSQYLPVQYWSVREGLLEPT PRSLIVDKIIQVLNDYTWACGG | Litorilinea aerophila |
| 16 | pA07074 | MERKVKHLTHMVEQHKRGNANGIYAVCSAH PLVLEAAIRYAQSHQTPLLIEATSNQVDQFGG YTGMTPEDFYGFVCCLAESLDFPTSQLILGGD HLGPNRWQNLPAQQAMANADDLIKSYVAAG FKKIHLDCSMSCEDDPVPLTDAIVAERAARLA KIAEATCREQFGVTDLVYVIGTEVPVPGGAHE TLTELEVTTPDAARATLEAHRHALEKEGLNDI WPRIIGLVVQPGVEFDHAHVCDYQPHKAVAL SKMVEAYDTLLFEAHSTDYQTPQALRQLVKD HFAILKVGPALTFALREALFSLAAIEEELLPAK ASSGLRHVLENVMLDRPEYWQSHYHGDGNA RRLARGYSYSDRVRYYWPDSQIDDAFERLVR NLADEPIPLPLISQYLPLQYGKVREGALKSTPR ELIIDHIQDILQQYHAACEGVTTQNA | Enterobacter mori. |
| 17 | pA07075 | MWLDSNFLKNRGIFSICSSNENVLDASIEFAKE KEDFLLIEATCHQVNQFGGYTKMTPESFSKKIF KKAEEMNFNPERLLLGGDHLGPEPWKNENAD TAMDKAKQLVIEFVKNGFNKIHLDCSMPLKG DSDFSTTLVADREAELCAVAEETYEKYGGNRP VYVVGTEVPAPGGSTNEVPEVTSIEELDEMIEE LQNAFLRLGLKNAWDRVIAIVVRLGIGFGGDS VSEYESEKTKELCTYLSRYYPSLYFEAHSTDY QTAGSLKQMVKDGIRILKVGPALTDAYRRGM FALNFIEKESIDEEKQSRLVENVLKVMDEYPR YWEDYYNSVGKTLRLDQMYSYFDRIRYYWG FEEVEKSKNRLIENLKDMQMNLIRQYLPEQYE KIRENKLNKDPRALINYEIKKVLNDYQKSVILE | Caldisericum exile |
| 18 | pA07076 | MWLSKDYLRKKGVYSICSSNPYVIEASVEFAK EKNDYILIEATPHQINQFGGYSGMTPEDFKNFV MGIIKEKGIEEDRVILGGDHLGPLPWQDEPSSS AMKKAKDLIRAFVESGYKKIHLDCSMSLSDDP VVLSPEKIAEREREELLLEVAEETARKYNFQPVY VVGTDVPVAGGGEEEGITSVEDFRVAISSLKK YFEDVPRIWDRIIGFVIMLGIGFNYEKVFEYDRI KVRKILEEVKKENLFVEGHSTDYQTKRALRD MVEDGVRILKVGPALTASFRRGVFLLSSIEDEL ISEDKRSNIKKVVLETMLKDDKYWRKYYKDS ERLELDIWYNLLDRIRYYWEYKEIKIALNRLFE NFSEGVDIRYIYQYFYDSYFKVREGKIRNDPRE LIKNEIKKVLEDYHYAVNL | Dictyoglomus thermophilum |
| 19 | pA07077 | MQAQALLTVPFDRVATHARGFVGWVAELLL GPLAHQHTLLAVCPNSEAVTRAALEAAAEVN APLLFAATLNQVDLDGGYTGWTPATLARFVA DELARLDLHIPVVLGLDHGGPWKKDLHARNR LSFAETVQAVLRAIEACLDAGYGLLHLDPTVD LELPPGTPVPIPRIVERTVALLRHAETYRLRRN LPPVAYEVGTEEVGGGLQAEARMAEFLDRLW TALDREGLPHPIFVVGDIGTRLDTRTFDFERAC RLDALVRRYGALIKGHYTDDVDRLDLYPKAG IGGANVGPGLAAIEFEALEVLVDEARRRGLSV TFDQAIRRAVVESGRWTKWLQPEEKGRPFEAL | Rhodothermus marinus |

TABLE 3-continued

Native Sequences

| SEQ NO. | Plasmid ID | Sequence | Organism |
|---|---|---|---|
| | | DPERQRWLVATGSRYVWTHPAVLQARRELYE ALAPWLDADAFVRERIKARLMDYFRAFNLIHF NERLQAFLPE | |
| 20 | pA07078 | MQAHVLLAPSFEQLADHRHGFVGWLVDLLRG PLAYRHTLLAVCPNSEAVTRAALEAAREANAP LFFAATLNQVDLDGGYTGWTPATLARFVADE RIRLGLRAPVVLGLDHGGPWKKDWHVRNRLP YEATLQAVLRAIEACLDAGYGLLHLDPTVDLE LPPGTPVPIPRIVERTVALLQHAETYRQQRRLP PVAYEVGTEEVGGGLQAEARMAEFLDRLWTV LDREGLPRPVFVVGDIGTRLDTHTFDFERARR LDALVRRYGALIKGHYTDGVDRLDLYPQAGI GGANVGPGLAAIEFEALEALVAEAHRRKLPVT FDRTIRQAVIESGRWQKWLRPEEKGRPFEALP PERQRWLVATGSRYVWTHPAVRQARHQLYQ VLAPWLDADAFVRARIKARLMDYFRAFNLIGF NERLQAFLPN | Rhodothermus profundi |
| 21 | pA07079 | MAKIPIQSAVKALLELQDEGKGGTLLGIGPMS TNVLQASFELARDYDFPLMFIASRNQVDLDEL GGGYVNGWNQYTFVQAIREMAELTGFDGLY YVCRDHGGPWQRDKERNDHLPVEEAMALGK KSYLADIEAGFDLLMIDPTKDPFEIGKVIPLEK VIERTVELIEFCEKERQARDLPEIGYEVGTEET NGGLTSTETYETFILRLQEELGRRDLPMPTFIV GQTGTLVRKTEQAGRFSFENAADLAKMAKKY GVGLKEHNGDYLDDVILLAHIPSQITATNVAP QYGTEETRALLKLAKLEEKLKEQGLIGQPSKV KDVLLYHSIKSERWRKWMVGSQRELSVEEIV KDEELSTEILDIAGHYTFNIDEVKEEINKLYRN LSKAHIDGQRFVVDHIKRSIRNYVECFNLKGLT SRIKEKLNGSKNA | Caldibacillus debilis. |
| 22 | pA07080 | MKKISIFEIVKASLNMKGKDKATLLGIGPMSK TLIKASMILAKEKDFPLMFIASRNQVDLKELGG GYVCNWDQKSFASDIKKIAEEVGFNGLYFLCR DHGGPWQRDNERNAHLPENEAMELGKKSYL EDLINGFDLLHIDPTKDPYIVGKTVPMEIVLKR TIELIEYVERERKERNLPPISYEVGTEETNGGLT SEEAYETFIKTLIEELDKRNLPKPSFIVGQTGTL TRLTENVGNFNTKNSKKLADIAKKYSVGLKE HNGDYLDEAILLEHPALGITAMNVAPEFGSVE TQAYLKLIEVENNLYEHGIISKKSNLEKVIKEE AVKSLRWKKWMVGDKVNLSIEEVLSDKDLT DLITEISGHYTFNNERVKCEIQLMFDNLNKAG VDGEKYVINKIKDSIDKYIKYFNLEGFTTKVLS NV | Caloramator quimbayensis |
| 23 | pA07081 | MTDTNYKAKPGSLLFESLMDKETIILAINPRISL LNKGILKAAKDMDAPIILELAKSECNLEGGYT GFTPSEFSKRAYESAEEIGIDIWSLHADHIGIKK GTDEEIESIKKLVKAQIDAGYTSFAIDASHLFNF RGGNLREELKDNIEATTKVARFIDEQMEDRDY GLEVEVGEIGREDEYGRVLTQPEEAVTFIKAL NENGVYPQVLAIANGSAHGNTYDEYGHLIEQ VSIDIPQTMAVARALRDNNLNVRIAQHGITGTP IEMIHNHFPHGDIIKGNVGTFYLNLVWDVLKV FEPQLYGDIWDWTIENFSEKYPDKSENEIFGKY SKYAIKEFFDRIYSVGDDTIRAVESRAYADTLV FLKAFKAAGMAEHVRKNL | Methanosalsum zhilinae |
| 321 | pA06242 | MKLLEEFLKAFPGRPFKVYGSSLRIITDSYFFLGNDGKEKLLF VVGKKGICQLFDGQKIGQIGSNDVLMCKKTHENLLALRKI INLNPTTINKKASFGFGDRIGLATPAHAKVAKDFEVFPIFA QQSVRELSRTGRTYKDVLDDAVWGVFESGYNFEFGADA DHVKEIEDLEKASNEGFTMYTVDPSDHIKDVSKLSQKEFQ SLYQDNKIRRELEMRYVGKLYKFKDFEFRMTDEEFAEIFV TYIDAIEHVCKCYDVLKAKGKPFDFEVSIDETAVPTTPLAH IFIVKELRRRGIDFKTLALRFSGEWQKGIDYIGDMEMFRK EIITHSKISKELGGYKLSLHSGSDKFSVYPIFSEATEGEFHVK TAGTNYLEAIRVVAVKDPELYREIHKFALTKFEQDRKSYH VTTDLSKIPDVDKMKNEELVKLLDMPDSRQLIHITYGSVL TAKDENGRWLFKERILKVLQENEDLHYDFVEKHMRKHLS LLGLERRIEK | Pseudothermotoga thermarum |

TABLE 3-continued

Native Sequences

| SEQ NO. | Plasmid ID | Sequence | Organism |
|---|---|---|---|
| 322 | pA06243 | MFAEFQHLTRGKFVPYATSLRKSTDATFFLVRDELDKYLI VIGKKGICELFEGQKIGEIDRQDVVLCAKNDRNCQSLMSL FPSLKPQICNAKLSFGFGDRLGVATAAHAQCVQKEKLFPI FAQQSVREISRTERNWLDVLHSAVWGVFESGYDGPFGA DADHVKKIEDLESAARAGYTMFTIDPSDHVKDPAKFDKR ELVRFYEEHPMRRTLEMKYIGKSFTVLGEKLTFDEENFAE VFVTYIDAIEHVEKCYRALRAVCKTSFDLEVSIDETSVPTTS LAHIFFVQELVRRGVEFRTLALRFPGEWQKGIDYVGDIDL FSENLDKHVAIVKMFTGYRLSLHSGSDKFSVYPILAEKTDR TIHVKTAGTSYLEAIRVVAKFAPDLYRQIHKYALSRFDQDK ASYHVTTELSKIPDVDKLEDSELPSLLDQPDSRQLIHITYGS VLTAKKEGRSLFKDRIMRVLFEHEAEHYDFLKKHLGKHIQ LLGV | Pseudothermotoga hypogea |
| 323 | pA06244 | MAENIVEKFEKLFKGKYKIYYSSIRKLEKSFFFMIRDQKQK YLISIAKKRICEKFEGKKIGRINDLDILMCPTNDYNCKVIRTL FNINPSVCKKNTSFGFGDRLGLATPAHTTLINKYDVFPVL AQQSVRELSRTHRNFKDVLDSAIWGIFESGYEGEFGADA DHVKDINDLMQAAYEGYSMYTVDPSDHVKNIDKINQGE LVEFYKSHPLRKEIEMIYSGKVFSFEKSKFTMEDKELFRIFV TYVDAIEHVVKCYEAIKNTKKNFDFEVSIDETSIPTSPLAHI FIVHELRRRGVDFQTLALRFVGQWQKAIDYIGDLSVLESE LSMHCEIVKSLSGYRLSLHSGSDKFSVYRIFTHYCDGKLHV KTAGTSYLEAIRTVAEASPSLYRNIHKYALTCFEKDNTSYH VTADINKIPDVDNVEDSKVVNLLDIPEVRQLIHITYGSVLT EKINGKYLFRDEIYRILHENEFLHYKRIRDHLGKHLELLKN | Pseudothermotoga lettingae |
| 324 | pA06245 | MVTVLQTLLQRPRPLAEIDRTSLARFLTDVIRQQVYPTSLE PTSEGVFFLARDGREKRLGILSEAGLHDFEGVRHQLSLDG RTLIFQSCPLTAANARALRRHIPWTAPRPLGLRASVGCGD RLGLATPGHVRAVRKHKLAPVFAQQSIREMTRTGRTPQ QVLDEAMWGVFQEGWRQGYGADADHLKTEEDADRCI EAGFTFFTIDPSAYVDNEVDTADAATLEAKVAALPWEAL ETTLADLRRAYLGQHFQVGPYELSFEERTLMQALAKYGG AIAHTARMYRHIAGRMGNRPPFELEMSVDETEVPTSPAE HFFVARELQRLGVRWISLAPRFVGRLEKGVDYIGDLEEFE AHLKLHVAIARTLGPYKLSLHSGSDKFALYPLFARHAGELF HLKTAGTSYLEALRAVAELDPPLFREILDFARDRYETDRAT YHVSALLERVPKASDVPDDALPALLEQFDTRQVLHVTFG SVLTATDADGRPRFRDRLLAVLQENEETYYRLLEAHFDRH LAPFDAE | Rhodothermus marinus |
| 325 | pA06246 | MDIYEKIAAALKDNRHNIQLDGVKIYPQSYVEVDMVKMI MVKAAEKKVILAQGSGPLFQELEGEAYDDYKVCNCSHLN RVVLNKYLPYTKPSAFGKEIATIGLGDRLGIASPGHIQAVK GREIRPILAQQSIRELNLTNRTYRNVLDAACFAVFQEGYK DGFGADGDHLKTEEDIQSALDLGFTMITLDCSEMIDNTI DKLTDTEVEEKYYQLPQSVRERYETRYLDKCFELRNSKICF SKENLMKNVLIYGAAADFIVAIYEKQIKHRDQKIDFEVSID ETVTPTTPEAHYFVAREIYDRQVDINSMAPRFCGEFQKGI DYIGDIHQFEKEFQVHAEIADHFGYKISIHSGSDKFSVFQT IGRYTEGRFHVKTAGTNWLEAVRVVAEKNPNLYRKMHQ YALEHFDEARAYYHVTTDIEGIVPLEKVNDHELSQYMNE NNARQLLHITYGILLQAKDASGQYLFREDFFYTLEQHEAE YDEALRKHIGRHLEQLGK | Geosporobacter subterraneus |
| 326 | pA06247 | MEMQKLYEEVENKNIVKNDLVDLTIGESLKIKAYPLSVLK KDDAFFFIGKENYDKFLFVISAGKENGLLNEFEGELIDAGK DVTVKKCNLSTKNRKAVQKIFPHTAPIVLGLCNSFGCGDR LGVANAGHIRAIKQSNFRPILAQQSIRELTRTNRTPDDV MDAAVWAVLQEGYKDGFGSDADHLKTFEDIDLMLNAG FTMFTFDPSEHVDNEADNYSEDQLKQKLGEIDWSGLQD TSADAAKRYVDMTFNISERLSLTIQESDFLRAYAKYGNAI AHIKKMYDYLASKADKDTFEIEVSVDETESVTSPFEHFFFA NELNRLGVKYVSLAPRFIGDFEKGIDYKGDLNVFKTEYEK HLDITKYFGSYKISLHSGSDKFSAYRVIGSLKGAYTHVKTA GTSYLEALRVVAAKEPALFRDILDFCRDLYETEKRSYHVSA DINKVKPANQYSDTELIELFNQNDTRQVLHVTFGKVLTEK DSSGHFLFKDKIMKCLVENEESHYEFLEKHFLKHLECFK | Melioribacter roseus |
| 327 | pA06248 | MKQFLPAIELLAKGELPSNSNQIKVYEKSYTVEGNVHLLM VKNSGEKFILATGEGAIFDELTGTDVDGKGKACPLTYENR LVLNKYFDYTVPQAFGTEIATIGLGDRLGLASPGHIETVRE KNIKPVLAQQSIRELTLTNRSMNDMLDAAAFAVFQEGYK | Lysinibacillus sphaericus |

TABLE 3-continued

Native Sequences

| SEQ NO. | Plasmid ID | Sequence | Organism |
|---|---|---|---|
| | | GGYGADGDHIKEESDIQYALSLGASMITLDCSDHIDNTIE KASPEVLDEKFNALSEVVKQRYMEQYLGKTFEVNGLTLTL DETELKKNVLLYDKAIDYTTHVYNEYISKENRAIDFEISIDE TETVTSPISHFFVANELINRGVKVVSLAPRFCGEFQKGIDY IGDVEQFEVELREHALIAEHFGYKLSIHSGSDKFMVFPIIAE YTKGVFHVKTAGTNWLEAIRVIAATNPDLYRRMHVFALE NFEEALKYYHVTPDLNSFEKLENVEDAKLPEYMNNDAAR QLFHVTYGLLLTAKGENDTFLFRDEFFKTLDKYEEEYRDAL VSHIGKHIELLGL | |
| 328 | pA06249 | MGNWKDFVKDFCTKEKNIEVLRAEAEKAFGNYGVYPRSI NEVGNAIVMMARGENEKCLVVVGEDSRLQELKGNQTE ENGLKVKVCPLSNENCYVIRKIFPYTNPQPHKGKNITIGLG DRLGLASPGHIRLIRDLDVFPVLAQQSIRELNLTGRTYEDV ISAAAWAVFQEGYTKGYGADGDHLKTAEEVKMSLNVG MTMITLDCSEHIDNSAAHAGLSELREKYSRFTEEERERW ERKYLNRDVKIGNYSFHISEEDLIRMACVYGGAIRHTLDIY HNIIAKCGRPIDFEMSIDETLTPTSPASHYFVAQELIDGGV EITSLAPRFCGEFQKGIDYIGDLKQFTDEFAVHAAIADHFG YKISVHSGSDKFKVFPVVGEKTNGRYHLKTAGTNWLEAV RVIARHKPDLYRRMHAFALEHLEDAKKYYHIGAKVENIPA LETLADSELPELMNRDDSRQVMHITYGHILQAKDENGN PLFKDELYKVLYEYEEEYANALKKHIGRHLEGLGLL | Clostridium stercorarium |
| 329 | pA06250 | MPSQLPEPLPVPPEARAHPSFRLHEGAALWLAGARLAVL APPEHPALTRFRGEVQHVGDHRLLRAERRAENAAALRAL LPDLQPRPLGLVTSAGFGDRLGVATPGHVRAAQRYGAG VAPVFAQQSIREMTRTGRTPQEVLDDATWGAFAAGWR GALGADADHQKTVADLERCAAAGFTLFTVDPSDHVDDS AHGAPASDLEAKVAALPWRELETTRADFERYAGRRLELG DRELVLAREAVLRAGAKYARAVLHVATLYRHLEGKGAPF ELEVSVDETATPTSHAEHAVVALELRRLGVRWVGLAPRF VGRFEKGVDYRGDLGELKADLAGHAALARSLGPYKLSLH SGSDKFSVYPLIAEATGGMVHLKTAGTSYLEALRVAAQV APGLFREILTLGRERFAVDKQSYHISAALARVSEADTLTDD ELPRLLDDDDARQVLHVTFGSALDRYRAPLLRVLEAHDE AYQAGLAAHFAKHLTPFAEVAP | Truepera radiovictrix |
| 330 | pA06251 | MLKLLNESLKPLSIFIYSESLRKINDDLYIFVAKIKDLKKIGIV KQNQILYFSSPYFSEDKKIEGTNFLVNLYPLNFENYQKLKEI IPISPKVCDKKISFGTGDRLGLITSAQLSALKEYDLFPILAQ QSPRELIKTKRDFKDVLLKSAMGVLETGYTGKYGADADHI KDEKYLMEAIDAGYTMYTLDISDFIEKIKDLSEKALKEKYE KVSSFSKKIIDKYAGKRVKISDEEYFELSYNELCKSAIVYEKA LSFVEMVYEILKSKLSEFDIEVSIDEGERDTTPEDHFFVAQF LHDKGIDFKSLAPKFPGEFQKGIDYIGDIKEFERALKKHYA LTKALEGYRLSLHSGSDKFSIYKIFYKITEGNFHIKTSGTSW LEAVKVIAKFFPDLFVELYQIALENLEESKKAYKVNITKEEF PKEIKEDYMEFLHKDNVRQLFHISYGVLLDEKRKEIYDLLN QKEKEHYQYVSENIKKHLKNLFEEE | Dictyoglomus turgidum |
| 331 | pA06252 | MNDAVYALGRSSRNGTLQLIVRGNSTGFHGEQQGDALI CPLDAENARTLQERLPWLRPQPLGNRLSFGFGDRIGLAT PGHVDALRSADPTGRIAPIFAQQSVRENQRLNRTPQEV MTAAVWSLFAENWRLPWGADADHVKEPEHLAPYVAA GYTFYTIDPSDHVDNAAHTDDLAVLRSKCEALPWDILETT YLSLCENYCGRTIVAEKTTLHFDKETLLRALAKYGRALAHT VRIAAALRTALGGTSFDLEMSVDETDTPTSAHEHFFIANE LLRRNIPLVSLAPRFVGKFQKGVDYMGNLAEFEAELIRHV AVMRHFHCYKLSVHTGSDKFSIYPILARCAGENVHIKTAG TSYLEALRVAALRAPDLFRQMLETGRTCYEKDKKTYFLDC RPERVPPAATLDDADLPNLLDQFDARQLLHVTFGSILTTH GAALRNLLATYPNDYRSALRDHFARHIQPFVQA | Caldilinea aerophila |
| 332 | pA06253 | MMLSPEALAEGLRLYGLHLIVGSIRELPDGGAIFAARQGS ERRIGWIGETSPFPAPDPRMSMRVQEHLVWIHPWTWA HYRILRERLPALSPTRCDRPASFGAGDRLGMATAAQIAAL ERYPVFPVLAQQSPRELARTGRDFRSVLLDDAAWGVFASG FAGPFGADADHLQDDEQLRAAAEAGYSLYTFDLRRALAR GPRPWEALSPLARSVVAELADRRVEAPQGPRTLEESALR AAACRYEPALEEVVRGAEILRDQGIDADLEVSVDETEEET TPEAHAFIAVYLQRRGVALWSLAPRFPGVFEKAVDYEGE VERFAQAAALHTAVARTFGGHRLSLHSGSEKFRILPVFRE | Thermoflexus hugenholtzii |

TABLE 3-continued

Native Sequences

| SEQ NO. | Plasmid ID | Sequence | Organism |
|---|---|---|---|
| | | ATGGRFHVKTSGTTWLQAVRVVARAVPALFAELYAIARA HLEESRRDYPIALQPEALPPALPDDPEAALADRAVRQLFH ISYGVLLRERGPAIRALLEAHEAEHFTAVRENLERHLEALL K | |
| 333 | pA06254 | MIGNVLSTLEENGFKVYPDSLRKLGENIYIFVVKRQNEKM VGILSSSDVKLNGAYFSEDKNVSDKLRLNIYPFTFENYVTL NGKFHIGPTVCRGNSSFGTGDRLGLVTAAQLTALKKYDV FPILAQQSPRELIKTNRDFKDVLLKVVLGVLETGYIGHFGA DADHIKDEYYLLEGINAGYTMYTLDLSEQLIDISSLNPSEM RNKAQELSQVSKDIIKDFSGKKLDIISDSGYVVSEEELYKSA VAYENAMKFVDKVNNILKEKLSDFDMEISIDEGGKVTTLE DHLYVAEYLHRNGIDFFSIAPKFPGEFEKAVDYIGDLDEFL LELKKHYQLSRMIGGYKISLHSGSDKFSIYRIFSDITEKNFHI KTSGTSWLQAINLIYNYDKEFYRELYKIALENLEESKKSYKV LIKREDFCKEPELNNPKFILKPEIKQLFHISFGVLLNLRKEI VDFLNKYEEEHYKMVSKNIDNHLKEIFYKN | Thermoanaerobacterium thermosaccharolyticum |
| 334 | pA06255 | MFTILPKKGISLGLGDRIGIATPGHIKVAKKYNFFPVFAQQ SIRELNFTGRTFTDVRKDVLNALVEENYVGNSGFDGDHL KSDEEIQYALDSGITMLTLDCSEHMNKDSSIKDQIFEQFY NKSFFVNDMPIEYSDKNELNKIVSIYASVIERVIDVWNKFP KVNKKEVTFEVSVDETDVPTDEKTHFLISKYIYDEGVKIDT LAPRFPGEFQKAIDYIGNIQEFKKSLIKQDKIAKYFGYRLSI HSGSDKFSIYPIIGEVTQGNYHLKTSGTSYLEAIKVVAQKD PEFFKKIWQTCLDKREEMDKYYHLSCDPFSVPKDLSPTEY LQNPDARQTLHVSYMFVLNPQYDFREKFFEILTKYQNEY HENVANHIEKHVKELKIEEKS | Petrotoga mobilis |
| 335 | pA06256 | MATPGSLSFPRYSIGTGDRFGHEAEAQLRAVIEAGRLGR ALGIVWNKSYREHTIIGSRPEDVRRMADRAVSSLGWEG PYFVDADHITTKTVDLFLDSADFFTIDVAEAIGKGEVSPQE EEDLLASLGDLLNRELAIPGLSSPLAISEETARGTIRAYWPA VREAARIYRRIEQGASRPFVVEVSMDETDEPQRPPELLLIL AMIRKAGIPARTIAPKFSGAFYKGVDYVGDPHTFAREFED DLCVVRYAREQFALPEGLKLSVHSGSDKFSLYPLVREILSR HPQEGVHLKTAGTTWLEEVAGLAEAGGEALALAKEIALT CYSMIEELCAPYAAVIDIDPERLPSPGEIEEWSSGRFVEAL EHDPSNPSYNRDFRQLIHVGYKVAAQMGERFHQALEAH REVIAARVTRNLLERHIIPLFPGDIP | Spirochaeta thermophila |
| 336 | pA06257 | MLHVYLGKIPRPGFGIRIPEVVAPPLLSAFKSLGMTGSLM LSFNRETAPAEYIESSDPRLFYFGHTGTSIGGFIRSVKEYSK ALSVPVEVEADHVSILGSVERALKKIAGVPVEEPLSEEEVS WSIGYVERELREAAEAGGVDFVTIDTCELIDYSYDKVGAE EVAAAYEEVFDGDERRALEERYEGVHYFLGGDRVVAVRL SREDVARLAVKYRRSLDYAERIYRAAREAMGVELGFEVA FDETPGVSEAREVFFYLSELLRRGLRVDFIAPNVGFRKRED YSGDLHALYERLRNLHAVVSSMNAYLSIHSGSGSHPYSDK GFGVWGVVGRATGGAVKYKMSGVLVQLLLEVMASYPP GSETRRLYEEIYSEVVEHLRWVVKAKASLYSPELETLLKRY EAAQDRFDPRADVFRHYFYVFQALRDEGGARRLRERLVE HYRENPGLRERYEKELRGLVERLASQLGYAGNAYRYRVV YA | Thermofilum pendens |
| 337 | pA06258 | MVTVLQTLLQRPRPLAEIDRAALARFLTDLIRQQVYPASL EPTSEGVFFLARDGREKRLGILSEAGLHDFEGARHQLSLD GRTLIFQSCPLTAANARALRQHLAWTAPRPLGLRASVGC GDRLGLATPGHVRAVRKHKLAPVFAQQSIREMTRTGRT PQQVLDEAMWGVFQEGWRQGYGADADHLKTEEDAD RCIEAGFTFPTIDPSAYVDNEVDTADAATLEAKVAALPW DALETTLADLRRAYLGQHFQVGPYELSFEERTLLQALAKY GGAIAHTARVYRHIAGRMGNRPFELEMSVDETEVPTSP AEHFFVARELQRLGVRWISLAPRFVGRLEKGVDYIGDLEE FEAHLKLHVAIARTLGPYKLSHSGSDKFALYPLFARHAGE LFHLKTAGTSYLEALRAVAELDPPLFREILDFARDRYETDR ATYHVSALLERVPKASDVPDDALPALLEQFDTRQVLHVTF GSVLTATDADGRPRFDRLLAVLQENEETYYRLLEAHFDR HLAPFDAK | Rhodothermus marinus |
| 338 | pA06261 | MLNLLEELLKPFSIFVYPQSLRKINEELYIFVAKINNTKNIGII KQNQSIYFSNPYFSEDKKIEKTGFSVNIYPLNFENYQKLKEI IPINPKTCNKKISFGTGDRLGLVTSAQLSVLKDYNLFPILAQ QSPRELIKTKRDFKDVLLKSVIGVLEIGYTDSYGADADHIK DEKYLMEAIDAGYTMYTLDISDFIERIENLTSKEIREKYEKIS | Dictyoglomus thermophilum |

TABLE 3-continued

Native Sequences

| SEQ NO. | Plasmid ID | Sequence | Organism |
|---|---|---|---|
| | | SFSKKIIEKYAGKKIKISNEEYFELSYDELCKSAIVYEKALSFV EMVYEILRSKLLEFDIEVSIDEGERDTTPEDHFFVVQFLHE KGIDFKSLAPKFPGEFQKGIDYIGDIKKFENELKKQYALTK ALEGYRLSHSGSDKFSIYKSFYKITEGNFHIKTSGTSWLEA VKTIARYSPDLFLELYHIALENLEESKKAYKVSITKEEFPKEI KEDYIEFLKKPNVRQLFHISYGVLLDEKREEIYEILNKNEKE HYQYVSENIRKHLKNLFEEE | |
| 339 | pA06262 | MKEELSDYLLKNSFLLYPDSFRRLREDVYIFVAKKDSDKKI GLLTNGNFKLSSPHFAEDKYVEELGFYINLYPLTYENYLILK DNFGISPVTCKEKASFGTGDRLGLATPAHIKALKNYNVFP VLAQQSPRELVKTHRDFKDVFLKVILGVLEAGYAGGYGA DADHIKDEKYLIEAIDAGYTMYTLDLSDLLVKISDMPKSQL KEKAQSLSSQSREIIDRFKGKKFSISTDEDFAVSEDELYKSA LTYEKAMKFVEKVYGILKDRLQHFDLEISIDEGEKDTTVED HIFVAEYLHRKGIDFWSLAPKFPGEFQKAIDYKGDIKKFTS GLKKHYFLSKKLGGYKLSLHSGSDKFSIYKIFNEITEGNFHI KTSGTSWLQAINIIFERDKDLFNDLYKIALDNLEESKKAYK VLIDRDDFPQTIQTEDSQILLKPEIKQLFHISYGVLLDERRK EIYEVLNKYEEEHYEFVSKNIENHLKEIFNI | Thermoanaerobacter siderophilus |
| 340 | pA06263 | MVEKSILEKLTDFLLNHSFVLYPNSLRLKEDTYIFVAKKD ADKKIGILTKENFKLTSPYFVEDKNVKEIDFYLNLYPLSFEN YLILKNFGISPTPCRQKSSFGTGDRLGLVTPAHIVALKEYP VFPVLAQQSPRELEKTHRDFKDALLKVILGVLEAGYTGEF GADADHIKDEKYLLRAIEAGYTMYTLDVSELLTKILDISSN QVMQISPQSKEIIEAFKGKKISISEEEYTIREDELYKSALIYE KAMNFVEKVYSILKEKVKDFDLEISIDEGEKDTTVEDHIFV AEYLHKKGIDFWSLAPKFPGEFQKAIDYKGDINKFAVELK KHYAISQQLGGYKLSLHSGSDKFSIYEIFSEVTQHSFHIKTS GTSWLQAVNLIFEKNKKLFYELYKIALNNLEESKKAYKVLI DKDDFAEEPNLENVQILSQPEIKQLFHISYGVLLDEKKEEIY DVLDKYEEEHYQFVSANIKNHLGKIFNN | Thermoanaerobacter mathranii |
| 341 | pA06264 | MVEKGILEKLTDFLLNHSFVLYPNSLRLKEDTYIFVAKKD ADKKIGILTKENFKLSSPYFVEDKNVKEIDFYLNLYPLSFEN YLILKNFGISPTPCRQKSSFGTGDRLGLVTPAHIVALKEYP VFPVLVQQSPRELEKTRRDFKDALLKVILGVLEAGYTGEF GADADHIKDEKYLLRAIEAGYTMYTLDVSELLTKISDISSN QVMQISPQSKEIIEAFKGKKISISEEEYTIREDELYKSALIYE KAMNFVEKVYSILKEKVKDFDLEISIDEGEKDTTVEDHIFV AEYLHKKGIDFWSLAPKFPGEFQKAIDYKGDINKFAVELK KHYAISQQFGGYKLSLHSGSDKFSIYEIFSEVTQHSFHIKTS GTSWLQAVNLIFEKDKKLFYELYKIALNNLEESKKAYKVLI DKDDFAEEPNLENAQILSQPEIKQLFHISYGVLLDEKKEEIY DVLDKYEEEHYQFVSANIKNHLEKIFNK | Thermoanaerobacter italicus |
| 342 | pA06265 | MIGNVLSTLEENGFKVYPDSLRKLGENIYIFVVKRQNEKM VGILSSSDVKLNGAYFSEDKNVSDKLRLNIYPFTFENYVTL NGKFHIGPTVCRGNSSFGTGDRLGLVTAAQLTALKKYDV FPILAQQSPRELIKTNRDFKDVLLKVVLGVLETGYIGHFGA DADHIKDEYYLLEGINAGYTMYTLDLSEQLIDISSLNPSEM RNKAQELSQVSKDIIKDFSGKKLDIISDSGYVVSEEELYKSA VAYENSMKFVDKVNNILKEKLSDFDMEISIDEGGKVTTLE DHLYVAEYLHRSGIDFFSIAPKFPGEFEKAVDYIGDLDEFS LELKKHYQLSRMIGGYKISLHSGSDKFSIYRIFSDITEKNFHI KTSGTSWLQAINLIYNYDKEFYRELYKIALENLEESKKSYKV LIKREDFCKEPELNNPNFILKPEIKQLFHISFGVLLDLKRKE MVDFLNKYEEEHYKMVSKNIDNHLKEIFYKN | Thermoanaerobacterium thermosaccharolyticum |
| 343 | pA06266 | MIGNVLSTLEENGFKVYPDSLRKLGENIYIFVVKRQNEKM VGILSSSDVKLNGAYFSEDKNVSDKLRLNIYPFTFENYVTL NGKFHIGPTVCRGNSSFGTGDRLGLVTAAQLTALKKYDV FPILAQQSPRELIKTNRDFKDVLLKVVLGVLETGYIGHFGA DADHIKDEYYLLEGINAGYTMYTLDLSEQLIDISSLNASEM RNKAQELSQVSKDIIKDFSGKKLDIISDSGYVVSEEELYKSA VAYENAMKFVDKVNNILKEKLSDFDMEISIDEGGKVTTLE DHLYVAEYLHRNGIDFFSIAPKFPGEFEKAVDYIGDLDEFL LELKKHYQLSRMIGGYKISLHSGSDKFSIYRIFSDITEKNFHI KTSGTSWLQAINLIYNYDKEFYRELYKIALENLEESKKSYKV LIKREDFCKEPELNNPKFILKPEIKQLFHISFGVLLNLKRKEI VDFLNKYEEEHYKMVSKNIDNHLKEIFYKN | Thermoanaerobacterium thermosaccharolyticum |

TABLE 3-continued

Native Sequences

| SEQ ID NO. | Plasmid ID | Sequence | Organism |
|---|---|---|---|
| 344 | pA06267 | MIGNVLSTLEENGFKVYPDSLMKLGENIYIFVVKRQNEK MVGILSSSDVKLNGAYFSEDKNVSDKLRLNIYPFTFENYV TLNGKFHIGPTVCRGNSSFGTGDRLGLVTAAQLTALKKY DVFPILAQQSPRELIKTNRDFKDVLLKVVLGVLETGYIGHF GADADHIKDEYYLLEGINAGYTMYTLDLSEQLIDISSLNPS EMRNKAQELSQVSKDIIKDFSGKKLDIISDSGYVVSEEELY KSAVAYENAMKFVDKVNNILKEKLSDFDMEISIDEGGKV TTLEDHLYVAEYLHRNGIDFFSIAPKFPGEFEKAVDYIGDL DEFLLELKKHYQLSRMIGGYKISLHSGSDKFSIYRIFSDITEK NFHIKTSGTSWLQAINLIYDYDKEFYRELYKIALENLEESKK SYKVLIKKEDFGKEPELNNPKFILKPEIKQLFHISFGVLLDLK RKEIVDFLNKYEEEHYKMVSKNIDNHLKEIFYKN | Thermoanaerobacterium thermosaccharolyticum |
| 345 | pA06268 | MIGNVLSTLEENGFKVYPDSLRKLGENIYIFVVKRQNEKM VGILSSSDVKLNGAYFSEDKNVSDKLRLNIYPFTFENYVTL NGKFHIGPTVCRGNSSFGTGDRLGLVTAAQLTALKKYDV FPILAQQSPRELIKTNRDFKDVLLKVVLGVLETGYIGHFGA DADHIKDEYNLLEGINAGYTMYTLDLSEQLIDISSLNASE MRNKAQELSQVSKDIIKDFSGKKLDIISDSGYVVSEEELYK SAVAYENAMKFVDKVNNILKEKLSDFDMEISIDEGGKVT TLEDHLYVAEYLHRNGIDFFSIAPKFPGEFEKAVDYIGDLD EFLLELKKHYQLSRMIGGYKISLHSGSDKFSIYRIFSDITEKN FHIKTSGTSWLQAVNLIYKFDKEFYRKLYKIALSNLEESKKS YKVLIKKDDFKDEPELDNPEFTLRPEIKQLFHISFGVLLDLK GKEIKDMLNDYEEEHYKMVSDNIENHLKEIYYEK | Thermoanaerobacterium thermosaccharolyticum |
| 346 | pA06269 | MVGNVSSVLKESGFQIYPDSLRKLGENTYIFVVKKQKEK MIGILSNDELKLKEPYFSENKKISDNLQFNVYSFTFDNYVT LNGRFHIGPTICRENASFGTGDRLGLATAAQLDALKKFNV FPILAQQSPRELVKTNRDFKDVLLKVVLGVLETGYIGHYG ADADHIKDEKYLLEGIDAGYTMYTLDLSEQLFDVSGATSL EIKEKAKTLSDVSRKIVEDFSGKSLNVGFGGHLVSEDELLK SAVAYEAAMKFVEKVNDILKEKLNDFDLEISIDEGGKVTT LEDHLFVAEYLHRNGIDFFSIAPKFPGEFEKAIDYVGDVNE FERELKKHYDLTKLIGGYKLSLHSGSDKFSIYKIFSQTTEKN FHIKTSGTSWLQAVNLIYKSDKEFYRELYKIALSNLEESKKS YKVLIKKDDFKDEPELDNSEFIIRPEIKQLFHISFGVLLDLKG KEIKDMLYDYEEEHYKMVSDNIENHLKEIFYEK | Thermoanaerobacterium xylanolyticum |
| 347 | pA06270 | MLTILPNKGISLGLGDRIGIATHGHIKVAKKYNFFPVFAQ QSIRELNFTGRTFSDVRKDVLNALIEENYVGNSGFDGDHL KSDEEIQYALDSGITMLTLDCSEHMNNKDSSIKERIFDQF YNKSFFVNDMPIEYSNKNELNKIVSIYAGVIERVIDVWNK FPKVNKKEVTFEVSVDETDVPTDEKTHFLISKYIYDEGVKI DTLAPRFPGEFQKAIDYIGNLQEFKKSLIKQDKIAKYFGYR LSIHSGSDKFSIYPIIGEVTQGNYHLKTSGTSYLEAIKIVAQK DPEFFKKIWKTCLDKREEMDKYYHLSCDPFSVPKNLSPTE YLQNPDARQTLHVSYMFVLNPQYDFREKFFEILTKYQNE YHQNVANHIEKHVKELKVEEKS | Petrotoga mobilis |
| 348 | pA06271 | MVGNVSAVLKENGFKIYPDSLRKLGESTYIFVVKKQKEK MIGILSNDELNLKEPYFSENKKISDNLQFNVYPFTFDNYVT LNGRFHIGPTVCRENASFGTGDRLGMATAAQLGALKKF DVFPVLAQQSPRELVKTNRDFKDVLLKVVLGVLETGYIGH YGADADHIKDEKYLLEGIDAGYTMYTLDLSEQLFDISGAT PSAIKEKAEALSDVSKKIVEDFSGQSLNVGLEGHLVSEDEL LKSAIAYEGAMKFVEKVNDILKEKLNDFDLEISIDEGGKVT TLEDHLFVAEYLHRNGIDFFSIAPKFPGEFEKAIDYVGDVD EFKKALKKHYDLTKLIGGYKLSLHSGSDKFSIYKIFSQTTER NFHIKTSGTSWLQAVNLIYKSDREFYRELYKIALSNLEESK KSYKVLIKKDDFKDEPELDNPEFIVRPEIKQLFHISFGVLLD LKGKEIKDMLYEHEEEHYKMVSNNIENHLKEIYYEK | Thermoanaerobacterium saccharolyticum |
| 349 | pA06272 | MFTILPKRGISLGLGDRIGIATTGHIKVAKKYNFFPVFAQQ SIRELNFTGRTFIDVRKDALNALVEENYVGNSGFDGDHLK SDEEIQYALDSGITMLTLDCSEHMNKDSSIKDQIFEQFYN KSFFVNDMPIEYSDKNELNKIVSIYASVIERVIDVWNKFPK VNKKEVTFEVSVDETDVPTDEKTHFLISKYIYDEGVKIDTL APRFPGEFQKGIDYIGNIQEFKKSLIKQDKIAKYFGYRLSIH SGSDKFSIYPIIGEVTQGNYHLKTSGTSYLEAIKVVAQKDP EFFKKIWQTCLDKREEMDKYYHLSCDPFSVPKDLSPTEYL KNPDARQTLHVSYMFVLNPQYDFREKFIEILTKYQNEYH QNAANHIEKHVKELKVEEKIHQKN | Petrotoga mobilis |

TABLE 3-continued

Native Sequences

| SEQ NO. | Plasmid ID | Sequence | Organism |
|---|---|---|---|
| 350 | pA06273 | MTTPGSLSLPRYSIGTGDRFGHEAEAQLRAVIEAERLGM ALGIVWNKSYREHTIIGSRPEDVRRMADKAVSALEWEGP YFVDADHITTKTVELFLDSSDFFTIDVAEAIGQEEISPQEEE DLLSSLDDLLNRELAIPGLSNPLTISEETARETIRAYWPAVR EAARIHQRIEKGTSRPFVVEVSMDETADPQRPPELLLILA MIRKAGIPARTIAPKFSGSFYKGVDYVGDPEVFAREFEDD LCVVRYAREAFRLPEGLKLSVHSGSDKFSLYPLIKDILSRHP QEGVHLKTAGTTWLEEVTGLAESGGEALALAKEIALTCYS MIEELCAPYAAVIDINPDRLPSPGEIEDWSSGRFVEALEH DPSNPSYNRDFRQLIHVGYKVAAQMGERFHEALEAHRE VIAARVTRNLLERHIIPLFPGGAA | Spirochaeta thermophila |
| 351 | pA06274 | MRAKELFGEDVSIEIALDESPSETQLKELFFYINELLYKGLR FEFIAPNIGFRKREDYRGDLQELYNRVRKLHTIASNNGVY LSIHSGSGAHPYSDKGVGVWSTIGRATDGLVKYKMSGVL IQLLLEVMSRFPKGSTVRRVYEEIYDAVLDHLKKDISRGRG LASETLRKMIEDYEEHSNKYDVRADVFRHYFFVFQCIRDD SGVRYLRNRVIELFNEVKELRDRYREEVANLITREAEALGY INSVIRYRKYEYS | Ignisphaera aggregans |
| 352 | pA04536 | MVLKVFKDHFGRGYEVYEKSYREKDSLSFFLTKEEEGKILV VAGEKAPEGLSFFKKQRAEGVSFFFCERNHENLEVLRKYF PDLKPVRAGLRASFGTGDRLGITTPAHVRALKDSGLFPIF AQQSVRENERTGRTWRDVLDDATWGVFQEGYSEGFGA DADHVKRPEDLVSAAREGFTMFTIDPSDHVRNLSKLTEK ERNEKFEEILRKERIDRIYLGKKYSVLGEKIEFDEKNLRDAA LVYYDAIAHVDMMYQILKDETPDFDFEVSVDETETPTSPL FHIFVVEELRRRGVEFTNLALRFIGEWEKGIDYKGDLAQF EREIKMHAEIARMFEGYKISLHSGSDKFSVYPAFASATGG LFHVKTAGTSYLEAVKVISMVNPELFREIYRCTLDHFEEDR KSYHISADLSKVREVEKVKDEDLPGLFEDINVRQLIHVTYG SVLKDASLKERLFKTLEQNEELFYETVAKHIKRHVDLLEG | Thermotoga maritima |
| 353 | pA04539 | MINKVAEYLSGEGFYFYEKSFRKLSEDIYIFVVKKANEKSIG LLTQGDFTLSSPHFTERKYLKETGYYLNLYPLTYENFVILKD KFNIAPAPCDKKASFGMGDRLGLVTAAHIRAVENYDVFP VLAQQSPRELMKTHRSFKEAILKAILGVLEEGYTGKFGAD ADHIKDENYLMEAIDAGYTMYTLDLSDMLVKLSDYTESQ LKEKAEKLNITSKRIIERFKGKKFVMPTKEAFTVSEEELYKS ALTYEKAMDFVEKVYGILKDKVKNFDLEISIDEGDKDTTV EDHIFVAEYLHEKGIDFWSLAPKFPGEFQKAIDYIGDVDK FAVELKKHQFLSREFGGYKLSLHSGSDKFSIYKVFSEITEGE FHIKTSGTSWFQAVNLIFEKDKELFKELYQIALYNLEESKK AYKVLIDKKDFPENINLEDSQIVSKPEIKQLFHISYGVLLEE RKKQIFEVLNKYEEEHYEFVRKNIENHFKEIFSK | Caldanaerobacter subterraneus |
| 354 | pA07082 | MKENKVMNSFSAIYGNRYKVYEKSLKRKEKEFFFVIKDFQ RKYLVAAGPSYRIRKRDFQPDEEGVADNEGEFLFQICRLT HHNLTQLQSIFNYLQPSTTKMKPSFGTGDRLGIATPAHIQ AFEDKNIFPILAQQSVREMERTESNWQKVLDNAIWGCF EAGYEGKFGADADHVKDLKNLKEAIDCGFTFYTIDPSDHI DANILKLDKDELRNKYQQLPEKDALENSYLNKEYQIGSQK LTFTQDILIEIVLTYLEAIKHVEKCYKFLKDSHKGDFELEVSV DETPTPTSPLAHLWIASELQRRGVDFQNLAPHFIGDWEK GIDYIGNIDTFKEEFKLHCQIASQMGGYKLSLHSGSDKFS VYPIFAEETNGYFHVKTAGTSWLEAVKAIVVCDPALYRE MYEFALKCFEKDSFSYLLSTDLQKIPNIKELQDKELIQLFSN NNARQLIHITYGSILREKDSQNRYKFRDRIYKVLFENEDIH YENVSKHIRHHLGLLSV | Mesotoga infera |
| 355 | pA07083 | MQSREELKRAILSEFGDYNIYSESIYRAGGCVLFLAKDMG QKLLVVVEEETGSAFDRFVGPQVYHPSGKRVKEAPLQPV NAGIVRELLPFTAPVALGATGLSLGLGDRLGVASPGHLRLI KKTGVRPVLAQQSVRELTLTNRTYSDVLDAATWAVLQE GYEGGFGADGDHLKTAEEIKGALDLGFTMITLDASAHID NTVGQKAAKQVAELYHTLPADYTADMEEHYLGKAFIVG GMAITFDTETLQRLVLTYGKALAFMGYIYHTLIVNAGREV DFEISIDETATPTTPAAHYFVASELGRMGVKFTSLAPRFC GEFQKGIDYIGDLYQFEDEFKRHAAIADHFGYRLSIHSGS DKFSVFPIIGQYTRGRVHIKTAGTNWLEALRVVARINPAL FREIYAFAGEVFGEAKKYYHVTTDLTRLPDVAAMADDGL PTVLDHNDARQMLHITYGLVLTAANADGSYRFKDALYEL LFDHEDEYYAALERHIGRHLEKLTENLKG | Thermosinus carboxydivorans |

TABLE 3-continued

Native Sequences

| SEQ NO. | Plasmid ID | Sequence | Organism |
|---|---|---|---|
| 356 | pA07084 | MSWKDFAEELVGTSKEAVMKVAEYAEDYRIYPRSIIKKDK SFYFLAKIDQKKKLVILNKSKNFELFQGRIEELAGFKAKIGP LSHYNAEILREVFPFTAPSALGNKKPSIGLGDRLGIATPGH IEAVKESAAMPVFAQQSVRELNLTGRTFKSVLDDVSWA VFQEGYQAGFAADADHLKEKPDIKEALDLGYTMLTLDCT DYINDDLDQMSESEIENAYAEVPDYLREGLENQYLNKTF VLNSGYQLEYNQDNFKEIVLIYYKMLDFAKEIQHLIKTSAR NVDFEISIDETSTPTTPEAHFFVANELKRNNIEVNSLAPRF VGEFQKGIDYIGDLEQFEKEFKVHADIADRFGYKLSIHSGS DKFSVFPIIGRHTQGRVHVKTAGTNWLEAIRVVAENNPS LYRDIHAYALKKFEAAKEYYHVTTDLDKVPELARMSDQEL GELLEINEVRQLLHITYGFILQDKKDGRYIFRDKLYKFWDE YDKEYRRALERHIGRHLNKLGFYKN | Halanaerobium congolense |
| 357 | pA07085 | MSWKDFAEELVGTSKEAVMKVAEYAEDYRIYPRSIIKKDK SFYFLAKIDQKKKLVILNKSKNFELFQGRIEELAGFKAKIGP LSHYNAEILRKVFPFTAPSALGNKKPSIGLGDRLGIATPGH IEAVKESAAMPVFAQQSVRELNLTGRTFKSVLDDVSWA VFQEGYQAGFAADADHLKEKPDIKEALDLGYTMLTLDCT DYINDDLDQMSESEVENAYAEVPDYLREGLENQYLNKTF VLNSGYQLEYNQDNFKEIVLIYYKMLDFAKEIQHLIKTSAR NVDFEISIDETSTPTTPEAHFFVANELKRNNIEVNSLAPRF VGEFQKGIDYIGDLEQFEKEFKVHADIADRFGYKLSIHSGS DKFSVFPIIGRHTQGRVHVKTAGTNWLEAIRVVAENNPS LYRDIHAYALKKFEAAKEYYHVTTDLDKVPELARMSDQEL GELLEINEVRQLLHITYGFILQDKKDGRYIFRDKLYKFWDE YDKEYRRALERHIGRHLNKLGFYKN | Halanaerobium congolense |
| 358 | pA07086 | MSWKDFAEELVGTSKDAVKKVAEYAEDYRIYPRSIIKKEK SFYFLAKIDQKKKLVILNKSKNFDIFQGKTEKLAGFKAKIAP LSHYNAEIIREVFPFTAPSKIGNQTASIGLGDRLGIATPGHI EAVKKSNAMPVFAQQSVKELKLTGRSFKSVLDDVSWAV FQEGYQNGFGADADRLKEKPEIKEALDLGYTMLTLDCTD YINDNFDQTAESDIESAYAEVPDYLRDGLESKYLNKTFVL NSGYQLEYNKVNFKKIVLSYYQILDFVKEIQHLIKRSARDV DLEISIADSLNSTSPEAHFFVANEFKRNNIEVNSLALNFVG EFQKGIDYIGDLEKFEKDFEIHADIADRFGYKLSIHSGSDKF SIFPIIGRQTEGRAHIKTAGTNWLEAIRVVAENDPSLYREI HSYALKKFEEAKEFYQVNTDLSKVPELAVMSDQELGELLE IDAVRQLLHITYGFILQDKKDGRYIFRDRLYKLLDEYDKDY RSGLERHIGRHLNKLGFYKN | Halanaerobium saccharolyticum |
| 359 | pA07087 | MVKHFESVLEELSQRKVPTSTEEVTVYTPSFEEHAGSQVV MVKSGTEKMIVAAGAGELFEALSGEDIGKGKVCPLTHEN RLVLNQFFSYTAPQAFGTDIATMGLGDRLGIASPGHIDTV KERNVKPILAQQSIRELTLLNRTMTDILDAAAFAVFQEGY KDGYGADADHIKLESDIEHALQLGFSFLTLDCSEQIRNDV ESQTSDEIQNEFASLSDEKRAYFSNYYLDQTFNVHERQIS FDQANLAKNVLVYGEAIDFMEHVYHTYLQSLDRDVDFEI SIDETETVTSPEAHFFVAEELRRRGVKVESLAPRFCGEFQK GIDYIGDMDQFEKELKEHADIAKHFGYKLSIHSGSDKFSV FPIIGKYTDGLLHIKTAGTNWLEAVRVVAQENPDLYRRM HVYAEEHFEETLKYYHVTPDLDSVTPLKEQPDDQLPEYM NHDAARQLFHVTYGILLTAKDDAGNDLFRDEFFDTLLNK EDAYRQALAHHIGRHLDLLGLSKKVGIE | Gracilibacillus halophilus |
| 360 | pA07088 | MINKVAEYLSREGFHFYEKSFRKFSEDIYIFVVKKANEKSIG LLTQRDFTLSSPYFTERKYLKEIGYYLNLYPLTYENFVILKDK FSIAPSPCNKKVSFGMGDRLGLVTAAHIRAVQNYDVFPV LAQQSPRELMKTHRSFREAILKAILGVLEEGYTGKFGADA DHIKDENYLMEAIDAGYTMYTLDLSDMLVKLSDYTESQL KEKAEKLNITSKRIIEKFKGKKFVMPTEEAFTVSEEELYKSA LTYEKAMDFVEKVYGILKDKVKNFDLEISIDEGDKDTTVE DHIFVAEYLHEKGIDFWSLAPKFPGEFQKAIDYIGDVDKF AVELKKHQFLSREFGGYKLSLHSGSDKFSIYKVFSEITEREF HIKTSGTSWLQAVNLIFEKDKKLFKELYQIALYNLEESKKA YKVLIDKKDFPENINLEDSQIVSKPEIKQLFHISYGVLLEERK KQIFEVLNKYEEEHYEFVRKNIENHFKEIFSK | Caldanaerobacter subterraneus |
| 361 | pA07089 | MLPYLVARPLGLRKSAGCGDRLGLATPGHIRALRATFGR DEDAAMAPIFAQQSIRENARTGRTPQEVMDDAMWGV FQEGWRAGFGADADHLKTLADVDICAAAGYTFYTVDPG DHVDDEANTAAFPALEARVDALPWDVLDSSPADLAARL ADRPIDLGTLKVTLDRETLWRAAAKYGRAVAHTVTMYR HLAGAMGERPFELEMSVDETATVTSLAEHVYIAAELQRL | Litorilinea aerophila |

TABLE 3-continued

Native Sequences

| SEQ NO. | Plasmid ID | Sequence | Organism |
|---|---|---|---|
| | | GVRCVSLAPRYVGTFEKGVDYIGDLDAFEQSIAQHMAVS RTFGPYKLSLHSGSDKFSIYPIASRVAGDLVHLKTAGTSYL EALRAIAAMAPDLFRQIVAFARERYPTDRASYHVSAELEK MPDIAGWPDDRLPELLNDFHAREILHVTFGSVLNHPPFR EPFFTALRTHEETYSEMLERHFCRHFAPFAG | |
| 362 | pA07090 | MINKVAEYLSREGFYFYEKSFRKFSEDIYIFVVKKANEKSIG LLTQGDFTLSSPYFTERKYLKEIGYYLNLYPLTYENFVILKDK FSIAPSPCNKKVSFGMGDRLGLVTAAHIRAVENYDVFPV LAQQSPRELMKTHRSFKEAILKAILGVLEEGYTGKFGADA DHIKDENYLMEAIDAGYTMYTLDLSDMLVKLSDYTESQL KEKAEKLNITSKRIIERFKGKKFVMPTKEAFTVSEEELYKSA LTYEKAMDFVEKVYGILKDKVKNFDLEISIDEGDKDTTVE DHIFVAEYLHEKGIDFWSLAPKFPGEFQKAIDYIGDVDKF AVELKKHQFLSREFGGYKLSLHSGSDKFSIYKVFSEITEGEF HIKTSGTSWLQAVNLIFEKDKELFKELYQIALYNLEESKKA YKVLIDKKDFPENINLEDSQIVSKPEIKQLFHISYGVLLEERK KQIFEVLNKYEEEHYEFVRKNIENHFKEIFSK | Caldanaerobacter subterraneus |
| 363 | pA07091 | MFERKIEMINKVAEYLSREGFYFYEKSFRKFSEDIYIFVVKK ANEKSIGLLTQGDFTLSSPYFTERKYLKEIGYYLNLYPLTYE NFVILKDKFSIAPSPCNKKVSFGMGDRLGLVTAAHIRAVE NYDVFPVLAQQSPRELMKTHRSFKEAILKAILGVLEEGYT GKFGADADHIKDENYLMEAIDAGYTMYTLDLSDMLVKL SDYTESQLKEKAEKLNITSKRIIEKFKGKKFVMPTEEAFTVS EEELYKSALTYEKAMDFVEKVYGILKDKVKNFDLEISIDEG DKDTTVEDHIFVAEYLHEKGIDFWSLAPKFPGEFQKAIDYI GDVDKFAVELKKHQFLSREFGGYKLSLHSGSDKFSIYKVFS EITEGEFHIKTSGTSWLQAVNLIFEKDKKLFKELYQIALYNL EESKKAYKVLIDKKDFPENINLEDSQIVSKPEIKQLFHISYG VLLEERKKQIFEVLNKYEEEHYEFVRKNVENHFKEIFSK | Caldanaerobacter subterraneus |
| 364 | pA07092 | MGMMDKDVLNQLSSLLSRHSFVLYPNSVRNLAEDIYVF VAKGNADKKVGILSKGKALGFKAPFFAEDIKVEATGFSFN LYPLSFENYLILRDEFGIALVPCKNKASFGTGDRLGLATPA HLDAFKSYNMFPVLAQQSPRELEKTHRDFRDVLLKAVLG VLEAGYTGEFGADADHIKDERYLLEAADAGYTMYTLDVS EMLVKGDVSPDKADHLSQHSRDIIKDFSGKRISFEGGEYT VKEEELYRSAVIYEKAMNFVERVHGLLKERLKDFDLEVSID EGDRDTTVEDHIFVAEYLHRRGIDFWSLAPKFPGEFEKAV DYRGDIDKFTVELNKHCAVARMLGGYRLSLHSGSDKFSV YRIFNDATQHNFHIKTSGTSWLQALNVIHEKDRQLFKELY NIALDNLEESKKAYKISIYRQDFEEGLDLDNLHVLQNPKVK QLLHISYGVLLDEKRQEIYEVLNQHEAEHYRYVSDNIKKHL ELLK | Caldicoprobacter faecalis |
| 365 | pA07093 | MKEELSNYLLKNSFLLYPDSFRRLKEDVYIFVAKKDSDKKI GFLTNGNFKLSSPHFLEDKYVEELGFYLNLYPLTYENYLILK DNFGISPVTCKEKTSFGTGDRLGLVTPAHIKVLKNYDIFPV LAQQSPRELVKTNRDFKDVLLKAILGVLEAGYAGGFGAD ADHIKDEKYLMEAIDAGYTMYTLDLSDLLVKISDMPESQL KEKAQSLSSQSREIIDRYKGKKFSISTDEDFVVSEDELYKSA LTYEKAMKFVEKVYGILKDRLQHFDLEISIDEGEKDTTVED HIFVVEYLHRKGIDFWSLAPKFPGEFQKAIDYKGDIKKFTS ELKKHYFLTKELGGYKLSLHSGSDKFSIYKIFNEITEGNFHIK TSGTSWLQAISLIFEKDKDLFNDLYKIALDNLEESKKAYKV LIDRDDFPQTIQTEDSQILSKPEIKQLFHISYGVLLDERRKEI YEVLNKYEEEHYEFVSKNIKNHLKEIFNI | Thermoanaerobacter uzonensis |
| 366 | pA07094 | MDLNGLLKDVEEILAKVDAGEKVESLSDAGVYVPSVQVD RRNVYFIYHTKDEKDHTVKTLVVYEENPTIGDFDALETLK GENSTLITAALTDHNNQALAKRFPWIKPTSRRNYKYTFGL GDRLGNASNAHLRLFKGTGIMPVLAQQSIRELTLMHRT NTDVLLSASWAVFEEGFTFGWGADGDHVKTEYEVDYA VKVGCSMITLDCTDVINNDAVTMSDEELDKTFNALDDD QKKYFNDTYLDKTFDLGNGNSVHFTKHDVEESVLTFYGA ILFAADIYKKFVVPYNLDFEISMDETPYQTTNPNHFFFGN ELHKRGIVPTTMAPRFYGEFQKAIDYIGDKDRFEREFVLH EAIAEYFGYKLSIHSGSDKLSVYEIIGRVAKNGWHVKTAG TNWLEALRVIAHKDPEFMVELYKAYEHLDDVKDFYVFN AQTDGKAPKPENVTVDNVVDVLSDDDGRQVLHTMYGS LMNLKHNYHYVFRDKFWDILLKNQDLYDKYLNIHIAEHID LLQGKYKTKEEALAALEPKTDISKEY | Lactobacillus ingluviei |

TABLE 3-continued

Native Sequences

| SEQ NO. | Plasmid ID | Sequence | Organism |
|---|---|---|---|
| 367 | pA07095 | MFTILPKKGISLGLGDRIGIATTGHIKVAKKYNFFPVFAQQ SIRELNFTGRTFTDVRKDVLNALIEENYVGNSGFDGDHLK SDEEIQYALDSGITMLTLDCSEHMNKDSSIKDQIFEQFYN KSFFVNDMPIEYSDKNELNEIVSIYASVIERVIDVWNKFPK VNKKEVSFEVSVDETDVPTDEKTHFLISKYINDEGVKIDTL APRFPGEFQKGIDYIGNVQEFKKSLIKQEKIAKYFGYRLSIH SGSDKFSIYPIIGEVTQGNYHLKTSGTSFLEAIKVVAQKDP EFFKKIWQTCLDKREEMDKYYHLSCNPFSVPKDLSPTEYL KNPDARQTLHVSYMFVLNPQYDFREKFFEILTKYQNEYH ENVANHIEKHVKELKIEETIHKQKK | Petrotoga mexicana |
| 368 | pA07096 | MFSKLPKQGISLGLGDRVGLATPGHIKVAKRHEFFPVFA QQSIRELNFTGRTFHDVKKDVENAVIKENYEGKSGFDGD HLKTDEEIKMAIDSGITMLTLDCSEYMGVVSKIKEKIYKGF YGKTFPKVKDLDLEYSQEELEKILSIYSGVIERIIYIWNNFPKV KNKDVSFEVSIDETNIPTDEKTHFLLSKYLYDEGITIDTLAP RFPGEFQKGIDYIGNIKEFKNSLMKHHKIASYFGYRLSIHS GSDKFSIYPYVSQITQGNYHLKTSGTSYLQALKIIAQKAPD FFKEIWKTCLDKRTEMDKYYHLSCDPFSVPKDLKPIEYLN NPDARQTLHVSYMFVLNPKYDFRNRFFEILTKYENEYHIE VAEHIKRHVKELKIPEKIQN | Defluviitoga tunisiensis |
| 369 | pA07097 | MFTILPKKGISLGLGDRIGIATPGHIKVAKKYNFFPVFAQQ SIRELNFTGRTFTDVRKDVLNALVEENYVGNSGFDGDHL KSDEEIQYALDSGITMLTLDCSEHMNKDSSIKDQIFEQFY NKSFFVNDMPIEYSDKNELNKIVSIYASVIERVIDVWNKFP KVNKKEVTFEVSVDETDVPTDEKTHFLISKYIYDEGVKIDT LAPRFPGEFQKAIDYIGNIQEFKKSLIKQNKIAKYFGYRLSI HSGSDKFSIYPIIGEVTQGNYHLKTSGTSYLEAIKVVAQKD PEFFKKIWQTCLDKREEMDKYYHLSCDPFSVPKDLSPTEY LKNIDARQTLHVSYMFVLNPQYDFREKFFEILTKYQNEYY ENVANHIEKHVKELKIEETK | Petrotoga miotherma |
| 370 | pA07098 | MFTILPKKGISIGLGDRIGIATPGHIKVAKKYNFFPVFAQQ SIRELNFTGRTFRDVRKDVLNALVEENYVGNSGFDGDHL KSDEEIQYALDSGITMLTLDCSEHMNKDSSVKESIFDQFY NKSFFVNDMPIEYSDKNELNKIVSIYASVIERVIDVWNKF PKVNKKEVSFEVSVDETDVPTDEKTHFLISKYIYDEGVKID TLAPRFPGEFQKGIDYIGNIQEFKKSLIKQDKIAKYFGYRLS IHSGSDKFSIYPIIGEVTQGNYHLKTSGTSYLEAIKVIAQKD PEFFKKIWQTCLDKREEMDKYYHLSCDPFSVPKDLSPTEY LQNPDARQTLHVSYMFVLNPQYDFRKKFFEILTKYQNEY HENVAHHIEKHVKELKVEETK | Petrotoga olearia |
| 371 | pA07099 | MKKLAKYSFGMGDRFAHQASWQLKAITEIEKQGIEVTPV WNKSNREHTTIGSKPEDNRDAACIKAIQKAGWSKPWYI DADHINLDTVDNFLESSDFFTIDVASYIGKKGDSKEEETFIS KMKPLIGNLNIPGVNSPFKITEQQLRNIAGQYLHAAFMA GETYKYIESVKGKGNFITEVSMDEVPEPQTPVELFFILAML AHYGVPAQTIAPKFTGRFNKGVDYVGDIETFRKEYEANL MVIDYAIQKFGFPPELKLSIHSGSDKFSIYPVIKELSQKHNK GFHLKTAGTTWLEEVIGLAMAGGEALLFVKNIYSRALDNI EKLCAPYADVIDINTDNLPKLSEVNNWTGEEFANALRHV PDHPMYNPDLRQLIHVAYKLAAENINQFNSFLEQHSEIV GKCVFENLYKRHAERLFVFSN | Thermophagus xiamenensis |
| 372 | pA07100 | MKQLERFSMGIGDRFGHQGKAQLEALAEAKHLGCTIIPV WNKSYREHSIIHTEPGQVRKEADWAVAALGWQDPYHV DADHISMKTVDLFLDSSDFFTLDVADYTGKAADEASIARF VAKHQHCIGKLQIPGIEQPITITETTLTSVARKYLLAIQEAG KLYRHIANKKGPENFITEVSIDETDQPQGPEDLLFILAMIA DEGIPAQTIAPKFTGRFNKGVDYVGNLTQFEREFNQDILV IAYASKEFGLPKNLKLSVHSGSDKFSIYPIIKKAIYTHHAGL HLKTAGTTWLEELIGLASAGDEGLRIVQQIYRETYYRFDEL CAPYATVIDIHKDKLPEPNSVQAWNGETYAAALRHIENH PQYNPHFRQLLHVGYKVAAELGETYLKALEAHEHHIALQ VKENLLDRHIRPIFIQ | Treponema caldarium |
| 373 | pA07101 | MLDTPRYLGKLPHLSVGVRLPEVFLEGIMSGFKTGNSAG GVMLSYHRETAPEYVINAPPGDFELTRGHTGTSIRHYIEA SVAKAKEKGVVVEVEADHVSVSVSSEAVKRISGGGTHRV LSEEEVRSALKYIEDEIREAVSTRNIYFYTIDTCDLIDYSSEKI AVDELRTVFKDLYPASLIERYKDINVVVNGTRIRFDEEKV MRLSLKLMRSIDVSERIYRIIKEMTPWPFGIEIAFDETPVTS DPHELFFVLNELRTRGIPVDFIAPNVGFQKREDFTGDLET | Thermofilum uzonense |

TABLE 3-continued

Native Sequences

| SEQ NO. | Plasmid ID | Sequence | Organism |
|---|---|---|---|
| | | LHSRVKTLHEVASFFGSLLSFHSGSGSSPYSMKGKGVHDII RRAAGGLFKYKISGVYFELLMQLMSRSDIPSVRRLYEEIYD AVIELLEDQVKRKGELYDEVLVKRLEEHRKKSLNGYVRDS ESPVFRYYSFLALNIRRNGERYLRNAIVELYLEDKGFREQV DREISALTVAFLDSLGFRGNVRLLR | |

Furthermore, the present disclosure provides polynucleotides encoding any of the polypeptides disclosed herein. The present disclosure also provides constructs, vectors, plasmids that comprises the polynucleotides. An expression vector carrying the polynucleotides of the disclosure may be any vector which is capable of expressing polypeptides having D-fructose C4-epimerase activity in the selected host organism, and the choice of vector will depend on the host cell into which it is to be introduced. Thus, the vector may be an autonomously replicating vector, i.e. a vector which exists as an extrachromosomal entity, the replication of which is independent of chromosomal replication, e.g. a plasmid, a bacteriophage or an extrachromosomal element, a minichromosome or an artificial chromosome. Alternatively, the vector may be one which, when introduced into a host cell, is integrated into the host cell genome and replicated together with the chromosome.

In the vector, the polynucleotides encoding for the D-fructose C4-epimerase active polypeptide should be operably combined with a suitable promoter sequence. The promoter may be any DNA sequence which confers transcriptional activity to the host organism of choice and may be derived from genes encoding proteins which are either homologous or heterologous to the host organism. Examples of suitable promoters for directing the transcription of the DNA fragment of the disclosure in a bacterial host are the promoter of the lac operon of *E. coli*, the promoter of the T7 RNA polymerase of T7 bacteriophage, the *Streptomyces coelicolor* agarase gene dagA promoters, the promoters of the *Bacillus licheniformis* α-amylase gene (amyL), the promoters of the *Bacillus stearothermophilus* maltogenic amylase gene (amyM), the promoters of the *Bacillus amyloliquefaciens* α-amylase gene (aqyQ), the promoters of the *Bacillus subtilis* xylA and xylB genes.

The host organism of the disclosure either comprising a polynucleotide or an expression vector as described above is advantageously used as a host cell in the recombinant production of a polypeptide according to the disclosure. The cell may be transformed with a DNA construct comprising the gene coding for the polypeptide of the disclosure or, conveniently by integrating the DNA construct into the host chromosome. Such an integration is generally considered to be advantageous as the DNA fragment is more likely to be stably maintained in the cell. Integration of the DNA constructs into the host chromosome may be carried out according to conventional methods such as e.g. by homologous or heterologous recombination or by means of a transposable element. Alternatively, the host organism may be transformed with an expression vector as described above.

In accordance with the disclosure, the host organism may be a cell of a higher organism such as an animal cell, including a mammal, an avian or an insect cell, or a plant cell. However, in preferred embodiments, the host organism is a microbial cell, e.g. a bacterial or a fungal cell including a yeast cell.

In some embodiments, the foregoing polypeptide or microorganism expressing the polypeptide is immobilized. In some embodiments, the polypeptide or the microorganism expressing the polypeptide is immobilized to a carrier or support. In some embodiments, the polypeptide or the microorganism expressing the polypeptide is immobilized to the carrier or support through adsorption, covalent attachment, non-covalent attachment, ionic interaction, entrapment, cross-linking, or metal-linking. In some embodiments, the carrier or support is an organic composition. In some embodiments, the organic composition is a natural polymer. In some embodiments the natural polymer is alginate, chitosan, chitin, collagen, carrageenan, gelatin, cellulose, starch, pectin, or sepharose. In some embodiments, the organic composition is a synthetic polymer. In some embodiments, the synthetic polymer is polystyrene, styrene divinylbenzene, polyvinyl chloride, polyacrylate, polyamide, polypropylene, diethylaminoethyl cellulose (DEAE cellulose), UV-activated polyethylene glycerol, or methacrylate. In some embodiments, the organic composition is functionalized with a chemical group to facilitate enzyme immobilization. In some embodiments, the functional group is an epoxy group, an amino group, a hydrocarbon, a tertiary amine, a quaternary amine, a carboxylic ester, nitrilotriacetic acid (NTA), iminodiacetic acid (IDA), aminophosphonic acid (AMPA), polyamine, or a carboxylic acid. In some embodiments, the carrier or support is an inorganic composition. In some embodiments, the inorganic composition is alumina, Zeolite, ceramics, celite, glass, silica, activated carbon, or charcoal. In some embodiments, the polypeptide or the microorganism expressing the polypeptide is immobilized without a carrier or support. In some embodiments, the polypeptide or the microorganism expressing the polypeptide is cross-linked to itself and/or an inert feeder protein using glutaraldehyde.

III. Modified Microorganisms

In another aspect, the disclosure provides a microorganism expressing any of the polypeptides disclosed herein. In some embodiments, the disclosure provides a microorganism expressing a polypeptide comprising an amino acid sequence that is at least 60%, at least 65%, at least 70%, at least 75%, at least 80%, at least 85%, at least 90%, at least 95%, at least 98%, or at least 99% identical to an amino acid sequence selected from the group consisting of SEQ ID NOs: 1-444. In some embodiments, the microorganism is modified. In some embodiments, wherein the modified microorganism is genetically modified. In some embodiments, the modified microorganism is non-naturally occurring.

In some embodiments, the modified microorganism is derived from *Escherichia coli, Corynebacterium glutamicum, Aspergillus oryzae, Pichia pastoris, Bacillus subtilis*,

*Caldithrix abyssi, Anaerolinea thermophila, Thermoanaerobacterium thermosaccharolyticum, Thermoanaerobacter thermohydrosulfuricus, Caldicellulosiruptor kronotskyensis, Dictyoglomus turgidum, Caldilinea aerophila, Rhodothermus marinus, Methanohalobium evestigatum, Clostridium cavendishii, Kosmotoga olearia, Butyricicoccus pullicaecorum, Clostridium thermobutyricum, Litorilinea aerophila, Enterobacter mori., Caldisericum exile, Dictyoglomus thermophilum, Rhodothermus profundi, Caldibacillus debilis., Caloramator quimbayensis, Methanosalsum zhilinae, Pseudothermotoga thermarum, Pseudothermotoga hypogea, Pseudothermotoga lettingae, Geosporobacter subterraneus, Melioribacter roseus, Lysinibacillus sphaericus, Clostridium stercorarium, Truepera radiovictrix, Thermoflexus hugenholtzii, Petrotoga mobilis, Spirochaeta thermophila, Thermofilum pendens, Thermoanaerobacter siderophilus, Thermoanaerobacter mathranii, Thermoanaerobacter italicus, Thermoanaerobacterium xylanolyticum, Thermoanaerobacterium saccharolyticum, Ignisphaera aggregans, Thermotoga maritima, Caldanaerobacter subterraneus, Mesotoga infera, Thermosinus carboxydivorans, Halanaerobium congolense, Halanaerobium saccharolyticum, Gracilibacillus halophilus, Caldicoprobacter faecalis, Thermoanaerobacter uzonensis, Lactobacillus ingluviei, Petrotoga mexicana, Defluviitoga tunisiensis, Petrotoga miotherma, Petrotoga olearia, Thermophagus xiamenensis, Treponema caldarium, Thermofilum uzonense.*

The modified microorganism according to the disclosure may, if it is intended for direct addition to a product where it is desired to have D-fructose C4-epimerase activity, e.g. during a manufacturing process, be provided in the form of a microbial culture, preferably in a concentrate form. Thus, such a culture may advantageously contain the microbial cell according to the disclosure in a concentration which is preferably in the range of $10^5$ to $10^{12}$ per g of culture. The culture may be a fresh culture, i.e. a non-frozen suspension of the cells in a liquid medium or it may in the form of a frozen or dried culture, e.g. a freeze-dried culture. The microbial cell may also for specific purposes be immobilized on a solid substrate.

In some embodiments, the foregoing microorganism expressing the polypeptide is immobilized. In some embodiments, the microorganism expressing the polypeptide is immobilized to a carrier or support. In some embodiments, the microorganism expressing the polypeptide is immobilized to the carrier or support through adsorption, covalent attachment, non-covalent attachment, ionic interaction, entrapment, cross-linking, or metal-linking. In some embodiments, the carrier or support is an organic composition. In some embodiments, the organic composition is a natural polymer. In some embodiments the natural polymer is alginate, chitosan, chitin, collagen, carrageenan, gelatin, cellulose, starch, pectin, or sepharose. In some embodiments, the organic composition is a synthetic polymer. In some embodiments, the synthetic polymer is polystyrene, styrene divinylbenzene, polyvinyl chloride, polyacrylate, polyamide, polypropylene, diethylaminoethyl cellulose (DEAE cellulose), UV-activated polyethylene glycerol, or methacrylate. In some embodiments, the organic composition is functionalized with a chemical group to facilitate enzyme immobilization. In some embodiments, the functional group is an epoxy group, an amino group, a hydrocarbon, a tertiary amine, a quaternary amine, a carboxylic ester, nitrilotriacetic acid (NTA), iminodiacetic acid (IDA), aminophosphonic acid (AMPA), polyamine, or a carboxylic acid. In some embodiments, the carrier or support is an inorganic composition. In some embodiments, the inorganic composition is alumina, zeolite, ceramics, celite, glass, silica, activated carbon, or charcoal. In some embodiments, the microorganism expressing the polypeptide is immobilized without a carrier or support. In some embodiments, the microorganism expressing the polypeptide is cross-linked to itself and/or an inert feeder protein using glutaraldehyde.

IV. Immobilization

The immobilization of the foregoing polypeptides and microorganisms can be achieved using techniques known in the art. Immobilized enzymes have a number of distinct advantages over soluble enzymes such as, for example, their use in continuous conversion systems. Exemplary of publications which review the art directed to enzyme immobilization are the following: Goldstein, in Fermentation Advances, Academic Press, New York, N.Y. (1969), pp. 391-424; Goldstein et al., Z. Anal. Chem., 243, pp. 375-396 (1968); Kay, Process Biochem., 3 (8), pp. 36-39 (1968); Tosa et al., Kagaku To Seibutsu, 7 (3), pp. 147-155 (1967); Silman et al., Ann. Rev. Biochem., 35 (2), pp. 873-908 (1966); Gryszkiewicz, Folia Biologica, 19 (1), pp. 119-150 (1971); Zaborsky, "Immobilized Enzymes", CRC Press, Cleveland, Ohio (1973); Datta et al., 3 Biotech. "Enzyme immobilization: an overview on techniques and support materials," 3(1): 1-9 (2013); Gotovtsev et al., "Immobilization of microbial cells for biotechnological production: Modern solutions and promising technologies," Appl. Biochem. Microbiol., 51: 792 (2015).

From the above noted publications, it is apparent that a number of enzyme immobilization techniques have been described. These techniques include covalently bonding an enzyme to a suitable insoluble carrier or support, encapsulation of an enzyme within a material which is impermeable to the enzyme but permeable to the substrate and the products of the catalyzed reaction, adsorption of an enzyme on an insoluble carrier and entrapment of an enzyme within a porous polymeric material wherein the pores are of such a size that will provide free access of the substrate and the catalyzed reaction products but which are sufficiently small to prevent the escape of the enzyme.

In some embodiments, the polypeptides disclosed herein or microorganism expressing the polypeptide is immobilized. In some embodiments, the polypeptide or the microorganism expressing the polypeptide is immobilized to a carrier or support. In some embodiments, the polypeptide or the microorganism expressing the polypeptide is immobilized to the carrier or support through adsorption, covalent attachment, non-covalent attachment, ionic interaction, entrapment, cross-linking, or metal-linking.

In some embodiments, the carrier or support is an organic composition. In some embodiments, the organic composition is alginate, chitosan, chitin, collagen, carrageenan, gelatin, cellulose, starch, pectin, sepharose, polystyrene, styrene divinylbenzene, polyvinyl chloride, polyacrylate, polyamide, polypropylene, diethylaminoethyl cellulose (DEAE cellulose), UV-activated polyethylene glycerol, or methacrylate. In some embodiments, the organic composition is functionalized with a chemical group. In some embodiments, the chemical group is an epoxy group, an amino group, a hydrocarbon, a tertiary amine, a quaternary amine, a carboxylic ester, nitrilotriacetic acid (NTA), iminodiacetic acid (IDA), aminophosphonic acid (AMPA), polyamine, or a carboxylic acid. In some embodiments, the organic composition is a natural polymer. In some embodiments the natural polymer is alginate, chitosan, chitin, collagen, carrageenan, gelatin, cellulose, starch, pectin, or sepharose. In some embodiments, the organic composition is a synthetic polymer. In some embodiments, the synthetic polymer is polystyrene, styrene divinylbenzene, polyvinyl chloride, polyacrylate, polyamide, polypropylene, diethylaminoethyl cellulose (DEAE cellulose), UV-activated polyethylene glycerol, or methacrylate. In some embodiments, the organic composition is functionalized with a chemical group to facilitate enzyme immobilization. In some embodiments, the functional group is an epoxy group, an amino group, a hydrocarbon, a tertiary amine, a quaternary amine, a carboxylic ester, nitrilotriacetic acid (NTA), iminodiacetic acid (IDA), aminophosphonic acid (AMPA), polyamine, or a carboxylic acid.

In some embodiments, the carrier or support is an inorganic composition. In some embodiments, the inorganic composition is alumina, zeolite, ceramics, celite, glass, silica, activated carbon, or charcoal. In some embodiments, the polypeptide or the microorganism expressing the polypeptide is immobilized without a carrier or support. In some embodiments, the polypeptide or the microorganism expressing the polypeptide is cross-linked to itself and/or an inert feeder protein using a cross-linking agent. In some embodiments, the cross-linking agent is glutaraldehyde.

V. Methods for Producing Tagatose

The present invention provides methods and compositions for converting fructose to tagatose. An economic biocatalytic process for conversion of fructose to tagatose will likely require an enzyme that remains active for extended periods of time at elevated temperatures. Elevated temperatures prevent contamination, can increase substrate solubility and can increase reaction rate. Enzymes from thermophiles are necessarily thermostable and active at elevated temperatures due to their organism's native environment. Therefore, enzymes from thermophiles were screened for D-fructose C4-epimerase (FC4E) activity.

In another aspect, the disclosure provides a method of producing tagatose, the method comprising: (a) contacting fructose with any of the polypeptides disclosed herein or a microorganism expressing the polypeptide; and (b) converting fructose to tagatose. In some embodiments, the method comprises: (a) contacting fructose with a polypeptide or a microorganism expressing the polypeptide, wherein the polypeptide comprises an amino acid sequence that is at least 60%, 65%, 70%, 75%, 80%, 85%, 90%, 95%, or 98% identical to an amino acid sequence selected from the group consisting of SEQ ID NOs: 1-444; and (b) converting fructose to tagatose. In some embodiments, step (b) converts fructose to tagatose through C4-epimerization of fructose. In some embodiments, the polypeptide comprises an amino acid sequence selected from the group consisting of SEQ ID NOs: 1-444. In some embodiments, the polypeptide consists essentially of an amino acid sequence selected from the group consisting of SEQ ID NOs: 1-444. In some embodiments, the polypeptide consists of an amino acid sequence selected from the group consisting of SEQ ID NOs: 1-444. In some embodiments, the polypeptide is capable of converting fructose to tagatose through C4-epimerization of fructose. In some embodiments, the polypeptide has D-fructose C4-epimerase activity.

In one aspect, the disclosure provides a method for producing a tagatose composition, comprising the steps of: (a) providing a starting composition comprising greater than about 0.3%, about 0.5%, about 1%, about 2%, about 3%, about 4%, about 5%, about 10%, about 20%, about 30%, about 40%, about 50%, about 60%, about 70%, about 80%, about 90% of fructose by weight; (b) contacting the starting composition with any of the polypeptide disclosed herein or a microorganism expressing the polypeptide; and (c) producing a tagatose composition comprising tagatose. In some embodiments, the polypeptide is capable of converting fructose to tagatose through epimerization at the carbon-4 position of fructose.

In some embodiments, the tagatose composition comprises tagatose in an amount greater than about 0.1%, about 0.2%, about 0.3%, about 0.5%, about 1%, about 5%, about 10%, about 15%, about 20%, about 25%, about 30%, about 35%, or about 40% by weight. In some embodiments, the tagatose composition comprises tagatose in an amount between about 0.3-80 wt %. In some embodiments, the tagatose composition comprises tagatose in an amount between about 0.5-60 wt %. In some embodiments, the tagatose composition comprises tagatose in an amount between about 1-40 wt %.

In some embodiments, the starting composition comprises fructose in an amount between about 0.3% to about 70% by weight. In some embodiments, the starting composition comprises fructose in an amount between about 10% to about 60% by weight. In some embodiments, the starting composition comprises fructose in an amount between about 20% to about 60% by weight. In some embodiments, the starting composition comprises fructose in an amount between about 20% to about 40% by weight. In some embodiments, the starting composition comprises fructose in an amount between about 30% by weight.

In some embodiments, contacting fructose with the polypeptide or the microorganism expressing the polypeptide is performed at a temperature between about 40° C. and about 100° C. In some embodiments, contacting fructose with the polypeptide or the microorganism expressing the polypeptide is performed at a temperature between about 50° C. and about 90° C. In some embodiments, contacting fructose with the polypeptide or the microorganism expressing the polypeptide is performed at a temperature between about 60° C. and about 80° C. In some embodiments, the contacting of fructose with the polypeptide or the microorganism expressing the polypeptide is performed at a temperature of about 60° C.

In some embodiments, the contacting of fructose with the polypeptide or the microorganism expressing the polypeptide is performed at between about pH 4.5 and about pH 8. In some embodiments, the contacting of fructose with the polypeptide or the microorganism expressing the polypeptide is performed at about pH 7.5.

In some embodiments, the contacting of fructose with the polypeptide or the microorganism expressing the polypeptide is performed in the presence of a metal ion. In some embodiments, the metal ion is a divalent metal cation. In some embodiments, the metal ion is $Zn^{2+}$, $Co^{2+}$, or $Ni^{2+}$.

In some embodiments, the method disclosed herein is a batch process. In some embodiments, the method disclosed herein is a continuous process. In some embodiments, the continuous process uses a fixed bed or fluidized bed reactor.

In some embodiments, the tagatose product is separated from the feed stock (fructose, glucose, and/or sucrose, etc.) through chromatographic means. In some embodiments, the tagatose is isolated from the feed using a chromatographic method. In some embodiments, the chromatographic method is simulated moving bed chromatography.

In some embodiments, the isolated tagatose is further purified with crystallization. In some embodiments, evaporative crystallization is used to make crystalline tagatose. In some embodiments, the tagatose product is crystallized. In some embodiments, the evaporative crystallization process is isothermal, and in another embodiment evaporative cooling is used. In some embodiments, the crystallization is isothermal evaporative crystallization or evaporative cooling crystallization. In some embodiments, the fructose is produced from glucose or sucrose.

In some embodiments, the polypeptide or the microorganism expressing the polypeptide is immobilized to a carrier or support. In some embodiments, In some embodiments, the polypeptide or the microorganism expressing the polypeptide is immobilized to the carrier or support through adsorption, covalent attachment, non-covalent attachment, ionic interaction, entrapment, cross-linking, or metal-linking. In some embodiments, the carrier or support is an organic composition. In some embodiments, the organic composition is alginate, chitosan, chitin, collagen, carrageenan, gelatin, cellulose, starch, pectin, sepharose, polystyrene, styrene divinylbenzene, polyvinyl chloride, polyacrylate, polyamide, polypropylene, diethylaminoethyl cellulose (DEAE cellulose), UV-activated polyethylene glycerol, or methacrylate. In some embodiments, the organic composition is functionalized with a chemical group. In some embodiments, the chemical group is an epoxy group, an amino group, a hydrocarbon, a tertiary amine, a quaternary amine, a carboxylic ester, nitrilotriacetic acid (NTA), iminodiacetic acid (IDA), aminophosphonic acid (AMPA), polyamine, or a carboxylic acid.

In some embodiments, the carrier or support is an inorganic composition. In some embodiments, the inorganic composition is alumina, zeolite, ceramics, celite, glass, silica, activated carbon, or charcoal. In some embodiments, the polypeptide or the microorganism expressing the polypeptide is cross-linked by a cross-linking agent. In some embodiments, the cross-linking agent is glutaraldehyde.

In some embodiments, the fructose is produced from glucose or sucrose. As a result, the present disclosure can provide a method for producing tagatose in high yield using common and inexpensive raw materials such as glucose, fructose, sucrose, and the like, which enables mass production of tagatose.

Accordingly, the present disclosure may further include hydrolyzing sucrose or isomerizing glucose to produce fructose prior to reaction of fructose with the composition according to any one of embodiments of the present disclosure. Enzymes utilized in hydrolysis may be β-D-fructosidase including β-fructofuranosidase, invertase, saccharase, sucrase, α-glucosidase, or α-D-glucohydrolase, without being limited thereto. Examples of the enzyme isomerizing glucose may include glucose (xylose) isomerase and phosphoglucoisomerase, without being limited thereto.

EXAMPLES

The following working examples are illustrative and are not intended to be limiting, and it will be readily understood by one of skill in the art that other embodiments may be utilized.

Example 1 Preparation of Recombinant Microorganisms Producing D-Fructose 4-Epimerase (FC4E)

The genomes of thermophilic organisms were searched for enzymes with putative FC4E activity. Two protein scaffolds were identified, and polynucleotides encoding amino acid sequences SEQ ID NO:1 to SEQ ID NO:23 (Scaffold1) and SEQ ID NO:321 to SEQ ID NO:373 (Scaffold2) derived from 56 thermophilic microorganisms (Table 3) were synthesized (GenScript) and inserted into the pARZ4 expression vector, generating the corresponding recombinant vectors: pA06233, pA06234, pA06235, pA06236, pA06237, pA06238, pA06239, pA06240, pA06241, pA07068, pA07069, pA07070, pA07071, pA07072, pA07073, pA07074, pA07075, pA07076, pA07077, pA07078, pA07079, pA07080, pA07081, pA06242, pA06243, pA06246, pA06247, pA06248, pA06249, pA06250, pA06252, pA06253, pA06254, pA06255, pA06256, pA06257, pA06261, pA06265, pA06266, pA06267, pA06268, pA06270, pA06271, pA06272, pA06273, pA06274, pA07082, pA07083, pA07084, pA07085, pA07086, pA07087, pA07088, pA07089, pA07090, pA07091, pA07092, pA07094, pA07095, pA07096, pA07097, pA07098, pA07099, pA07100, pA07101. The recombinant vectors were used in a heat shock method to transform competent $E.\ coli$ (NEBT7EL; New England Biolabs), thereby preparing recombinant microorganisms.

Each transformed recombinant microorganism was inoculated into 1 ml LB-kanamycin medium, cultured by shaking at 37° C. overnight. The culture was inoculated to 5 ml TB-kanamycin medium and grown for 2 hours at 37° C., followed by 25° C. for 1 hour. The culture was induced with 50 uL 50 mM IPTG and grown overnight. Finally, the culture was centrifuged at top-speed for 5-minutes and stored at −80° C.

The prepared $E.\ coli$ recombinant microorganisms were named as NEBT7EL-pA06233, NEBT7EL-pA06234, NEBT7EL-pA06235, NEBT7EL-pA06236, NEBT7EL-pA06237, NEBT7EL-pA06238, NEBT7EL-pA06239, NEBT7EL-pA06240, NEBT7EL-pA06241, NEBT7EL-pA07068, NEBT7EL-pA07069, NEBT7EL-pA07070, NEBT7EL-pA07071, NEBT7EL-pA07072, NEBT7EL-pA07073, NEBT7EL-pA07074, NEBT7EL-pA07075, NEBT7EL-pA07076, NEBT7EL-pA07077, NEBT7EL-pA07078, NEBT7EL-pA07079, NEBT7EL-pA07080, NEBT7EL-pA07081, NEBT7EL-pA06242, NEBT7EL-pA06243, NEBT7EL-pA06246, NEBT7EL-pA06247, NEBT7EL-pA06248, NEBT7EL-pA06249, NEBT7EL-pA06250, NEBT7EL-pA06252, NEBT7EL-pA06253, NEBT7EL-pA06254, NEBT7EL-pA06255, NEBT7EL-pA06256, NEBT7EL-pA06257, NEBT7EL-pA06261, NEBT7EL-pA06265, NEBT7EL-pA06266, NEBT7EL-pA06267, NEBT7EL-pA06268, NEBT7EL-pA06270, NEBT7EL-pA06271, NEBT7EL-pA06272, NEBT7EL-pA06273, NEBT7EL-pA06274, NEBT7EL-pA07082, NEBT7EL-pA07083, NEBT7EL-pA07084, NEBT7EL-pA07085, NEBT7EL-pA07086, NEBT7EL-pA07087, NEBT7EL-pA07088, NEBT7EL-pA07089, NEBT7EL-pA07090, NEBT7EL-pA07091, NEBT7EL-pA07092, NEBT7EL-pA07094, NEBT7EL-pA07095, NEBT7EL-pA07096, NEBT7EL-pA07097, NEBT7EL-pA07098, NEBT7EL-pA07099, NEBT7EL-pA07100, and NEBT7EL-pA07101.

Example 2 Purification and Measurement of D-Fructose 4-Epimerase Activity 2-1. Purification of D-Fructose 4-Epimerase The 76 microorganisms expressing D-fructose C4-epimerases created in Example 1 were dissolved in lysis buffer (lysozyme, DNAseI, Bugbuster, 300 mL 20 mM $PO_4$ pH 7.5, 500 mM NaCl, and 20 mM Imidazole). Two to three glass beads were added to each well and were disrupted by shaking at 25° C. and 220 rpm for 30 minutes. The disrupted liquid was centrifuged at 2200×g for 6-10 minutes. The obtained supernatant was loaded onto a Ni-NTA plate and shaken for 10 minutes at room temperature. The plate was centrifuged for 4 minutes at 100×g followed by two washes of 500 uL binding buffer (300 mL 20 mM $PO_4$ pH 7.5, 500 mM NaCl, 20 mM Imidazole) and two minute centrifugation (500×g). The proteins were eluted with 150 uL elution buffer (15 mL 20 mM $PO_4$ pH 7.5.5, 500 mM NaCl, 500 mM Imidazole) and shaken for 1 minute at 0.25 maximum shaking speed followed by centrifugation for 2 minutes at 500×g. The recovered protein was desalted into a buffer solution for enzyme activity evaluation (Scaffold1: 20 mM $KPO_4$, 50 mM NaCl, 300 uM $CoCl_2$, pH 7.5; Scaffold2: 20 mM $KPO_4$, 50 mM NaCl, 300 uM $NiCl_2$, pH 7.5).

2-2. Measurement of D-Fructose 4-Epimerase Activity

In order to identify the activity of the 76 D-fructose C4-epimerases purified in Example 2-1, the enzymes were reacted with fructose substrate at 60° C. The reaction was started by reacting 20 mM fructose with purified enzyme in buffer (Scaffold1: 20 mM $KPO_4$, 50 mM NaCl, 300 uM $CoCl_2$, pH 7.5; Scaffold2: 20 mM $KPO_4$, 50 mM NaCl, 300 uM $NiCl_2$, pH 7.5) and allowed to react overnight, followed by quenching the reaction product by placing the reaction at −80° C.

All monosaccharides were analyzed using an Agilent 6545 q-tof run in negative/high sensitivity mode. Sugars were separated using a Varian Hi-plex Pb++ column (100 mm×7.7 mm). A 4:1 mixture of methanol and chloroform was added to the reference mix to induce the formation of Cl+ adducts. Quantification was performed on the (M+Cl)− adduct of 215.0320 m/z. Standards of fructose and tagatose were purchased from Sigma Aldrich and calibration was performed from 1 to 1000 ppM.

Figure 2:
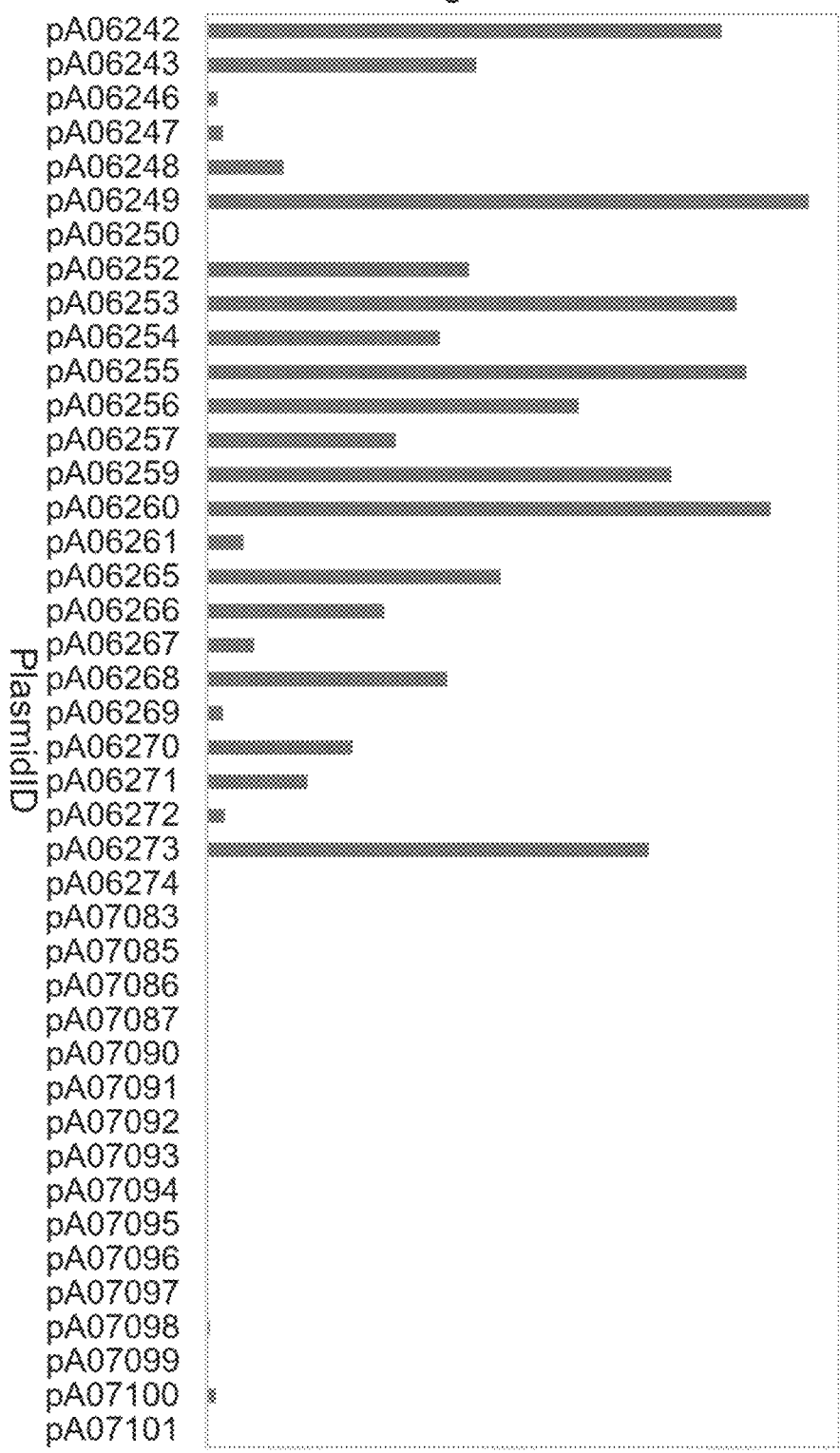
FIG. 2 depicts the measured fructose to tagatose yield for fifty-three thermophilic D-fructose C4-epimerases (Scaffold2). The FC4Es were reacted with 20 mM fructose at 60° C. overnight.
Figure 3:
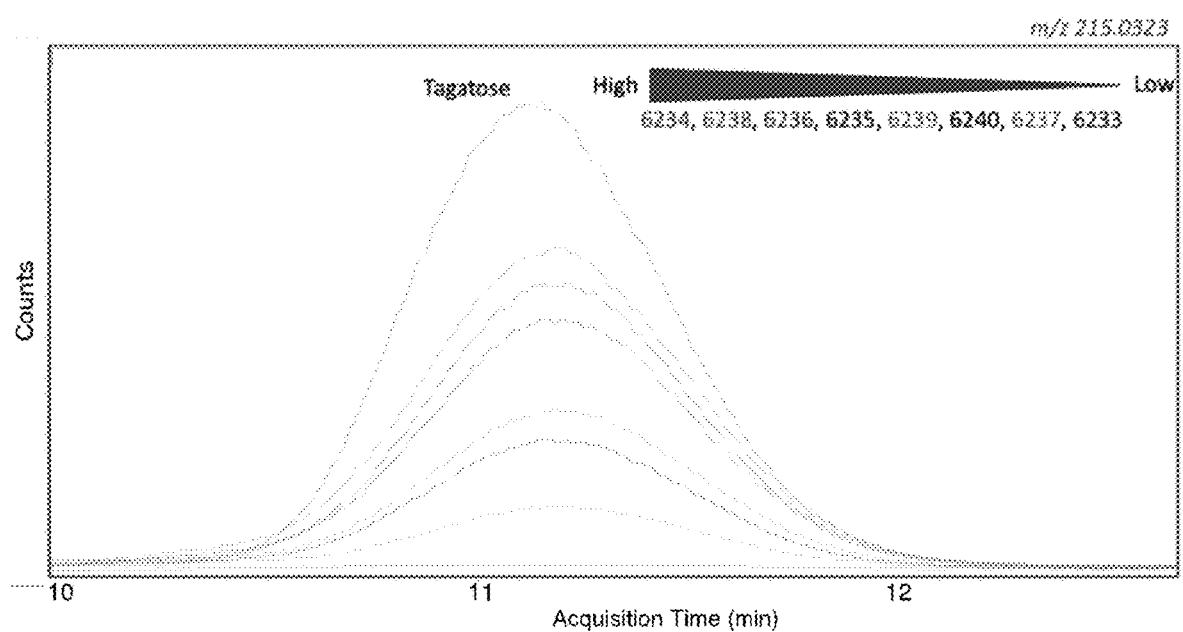
FIG. 3 depicts measured Q-tof traces of the conversion of fructose (20 mM) to tagatose for 8 of the thermophilic D-fructose C4-epimerases (Scaffold 1).
Figure 4:
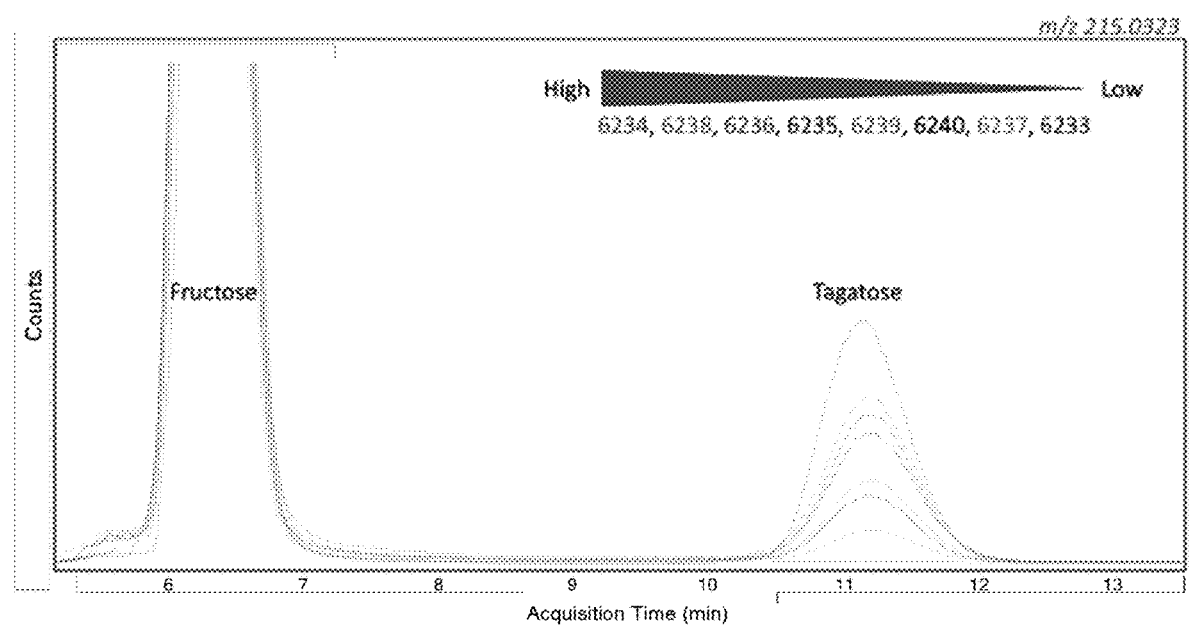
FIG. 4 depicts measured Q-tof traces of the conversion of fructose (20 mM) to tagatose for 8 of the thermophilic D-fructose C4-epimerases (Scaffold 1).

The D-fructose C4-epimerases successfully produced tagatose from fructose. The relative conversion rates are shown in FIG. 1 (Scaffold1) and FIG. 2 (Scaffold2). Specific Q-tof traces for a subset of the FC4Es are shown in FIG. 3 and FIG. 4.

2-3. Activity Analysis of Alternate Metal Ions.

Figure 5:
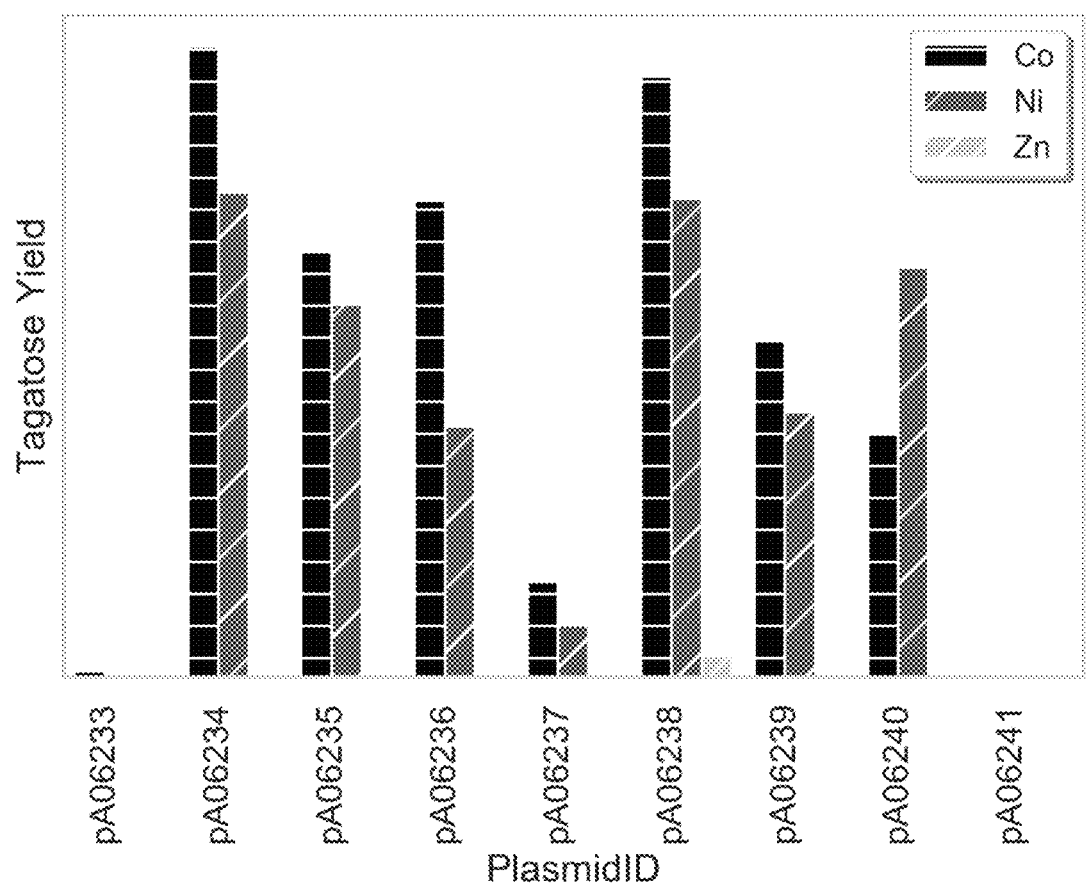
FIG. 5 depicts the impact of metal salt on measured tagatose yield from fructose for 9 FC4Es.

In order to determine the dependence of epimerase activity on metal salt type, a subset of the Scaffold1 purified enzymes from Example 2-1 were tested for activity with alternative metal salts: 0.3 mM $NiCl_2$ and 0.3 mM $ZnCl_2$ (FIG. 5). All conditions were the same as in Example 2-2 except $CoCl_2$ was substituted with an alternate metal salt.

Example 3 Activity of D-Fructose 4-Epimerases in High Sugar

Figure 6:
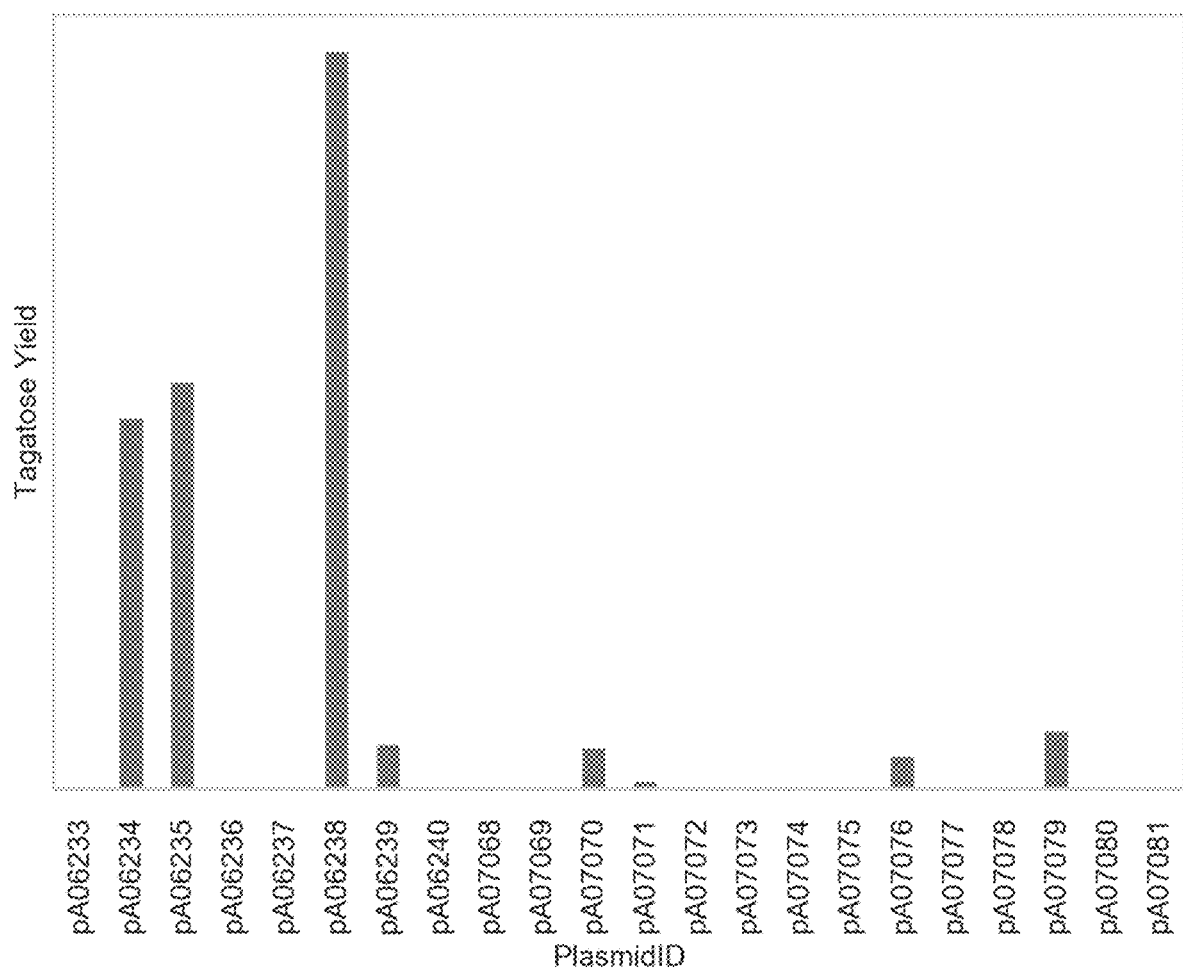
FIG. 6 depicts the relative fructose to tagatose yield when a high concentration of fructose substrate (1M) was used in the reaction.

In Example 2-2, the putative D-fructose C4-epimerases were screened at a low sugar concentration to determine if any activity was present. However, an industrially useful enzyme should be active at higher substrate concentrations. Therefore, the FC4Es were challenged with 1 M fructose. The experiments were conducted similarly to those in Example 2-2, except 1 M fructose was used as substrate and the reaction was limited to 20 minutes instead of overnight. Several FC4Es showed activity in these more challenging conditions (FIG. 6).

Example 4 Heat Stability of D-Fructose 4-Epimerases

Figure 7:
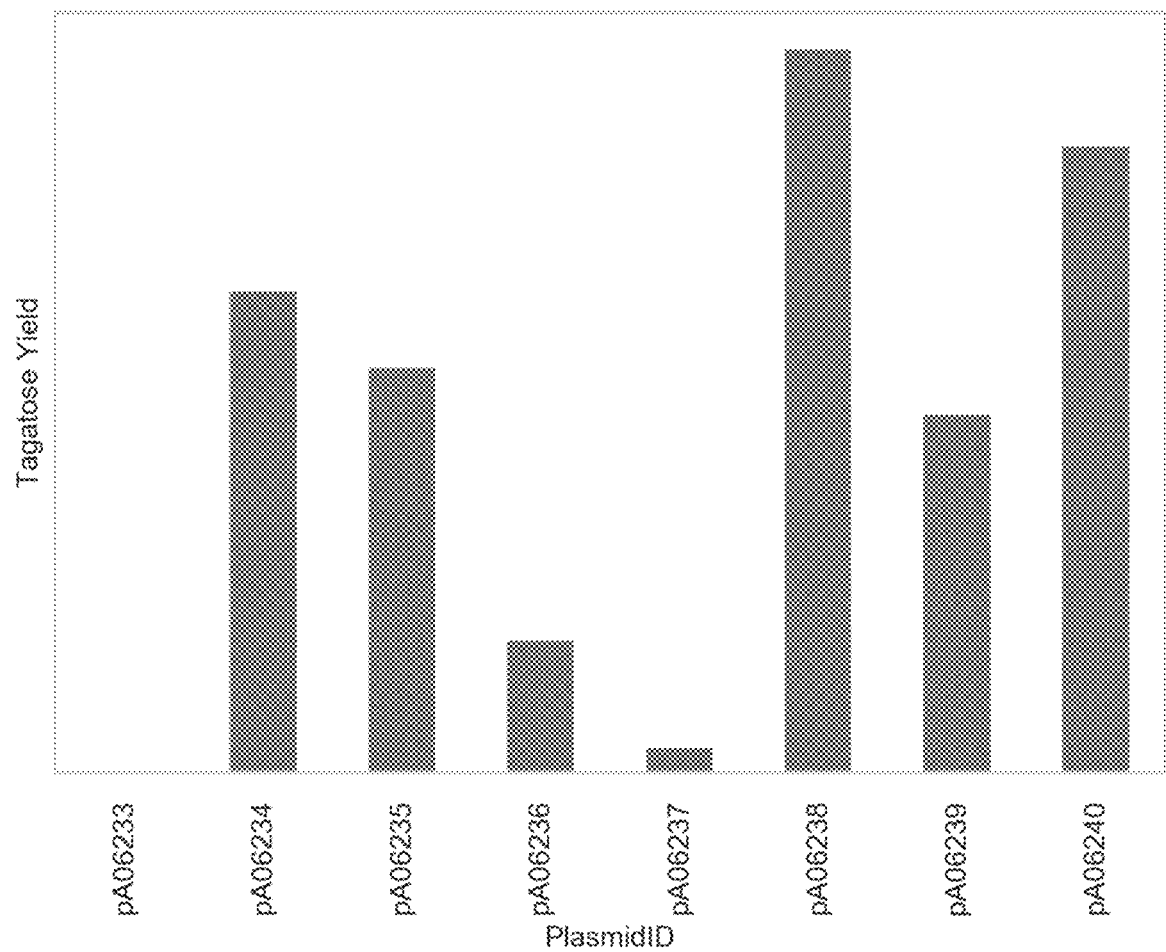
FIG. 7 depicts the relative fructose to tagatose yield for 8 FC4Es after the FC4Es were incubated at 60° C. for 24 hours prior to reacting with fructose.

Eight FC4Es pA06233-pA06240 were tested for heat stability. Enzymes were expressed and purified similar to Example 2-1. The FC4Es were incubated at 60° C. for 24 hours and then each enzyme was reacted with fructose (final concentration of 0.57M) for 20 minutes at 60° C. The conversion of fructose to tagatose was measured as described in Example 2-2. The relative tagatose yield for the enzymes can be seen in FIG. 7.

Example 5 Characterization of Top D-Fructose 4-Epimerases

Figure 8:
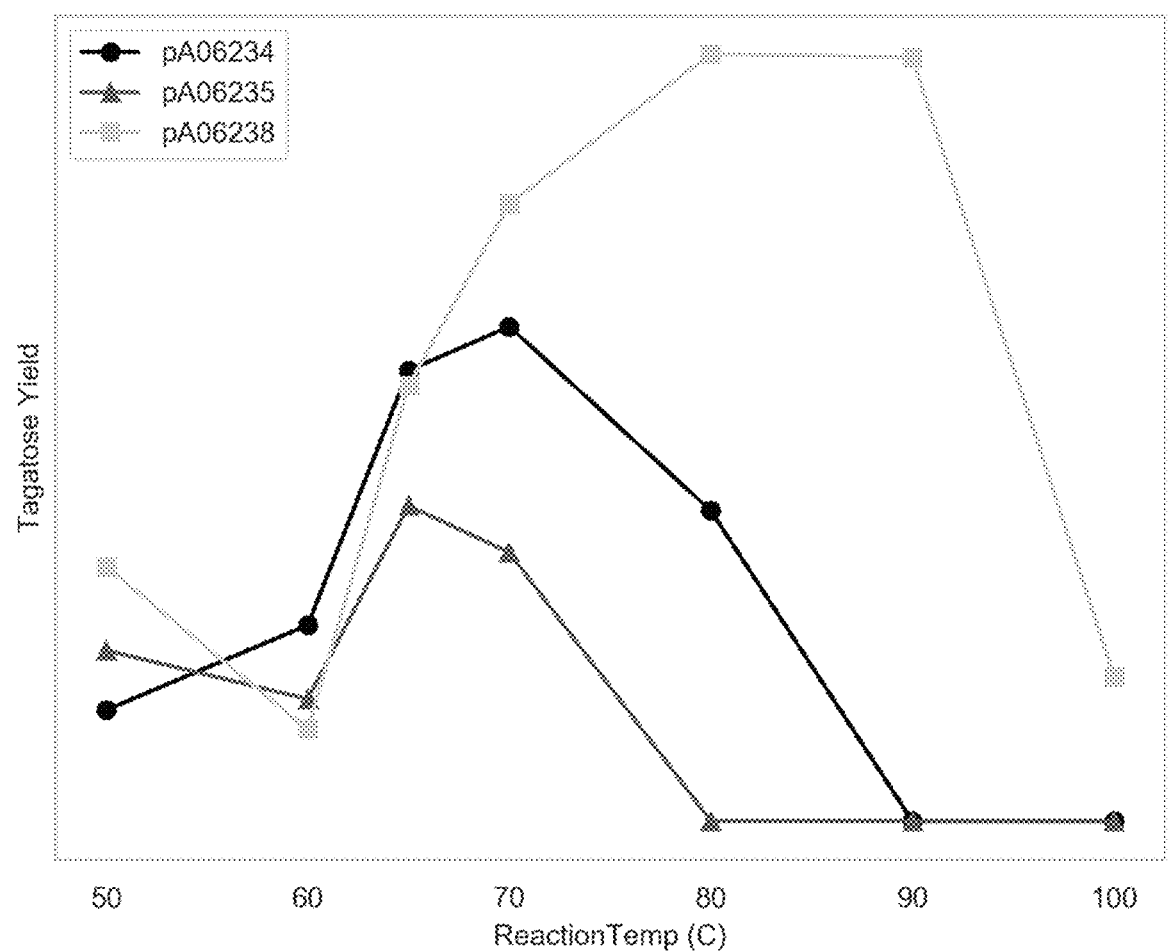
FIG. 8 depicts the impact of temperature on tagatose yield for 3 FC4Es.

Top FC4Es were further characterized to determine how their activity varied with temperature, sugar concentration, reaction time, and protein concentration. To determine the temperature optimum, enzymes pA06234, pA06235, pA06238 were purified as in Example 2-1 and reacted with 1.9 M sugar for 20 minutes in buffer (20 mM $KPO_4$, 50 mM NaCl, 300 uM $CoCl_2$, pH 7.5) at the following temperatures: 50° C., 60° C., 65° C., 70° C., 80° C., 90° C. and 100° C. The conversion of fructose to tagatose was measured the same as Example 2-2. The relative yield of tagatose over the measured temperature range is shown in FIG. 8.

Figure 9:
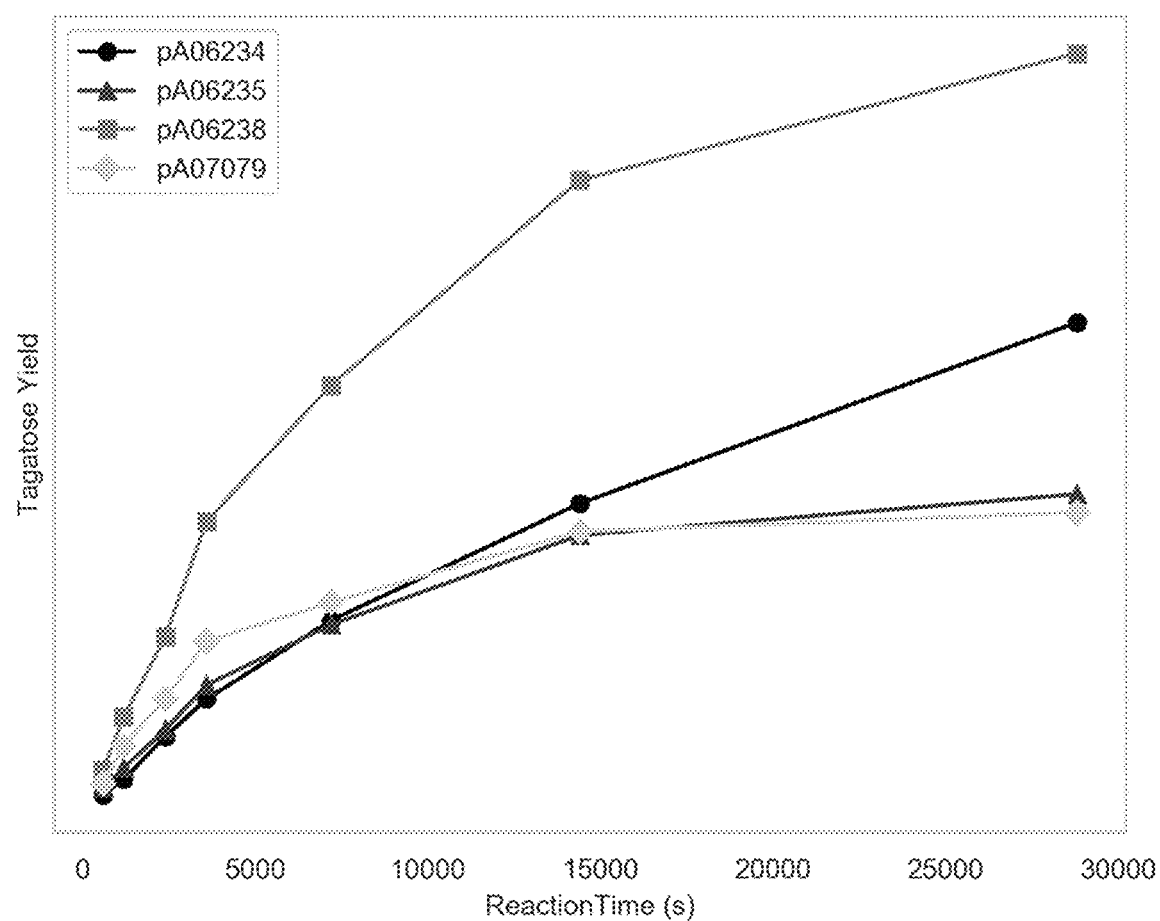
FIG. 9 depicts the fructose to tagatose yield over time for 4 FC4Es.

Next, the conversion of fructose over time was measured for FC4Es pA06234, pA06235, pA06238 and pA07079. Purified protein was obtained as in Example 2-1. FC4E was reacted with 1.9 M fructose in 20 mM $KPO_4$, 50 mM NaCl, 300 uM $CoCl_2$, pH 7.5 for 0-24 hours at 60° C. The conversion of fructose to tagatose was measured as in Example 2-2. The relative yield for the measured reaction times is shown in FIG. 9.

Figure 10:
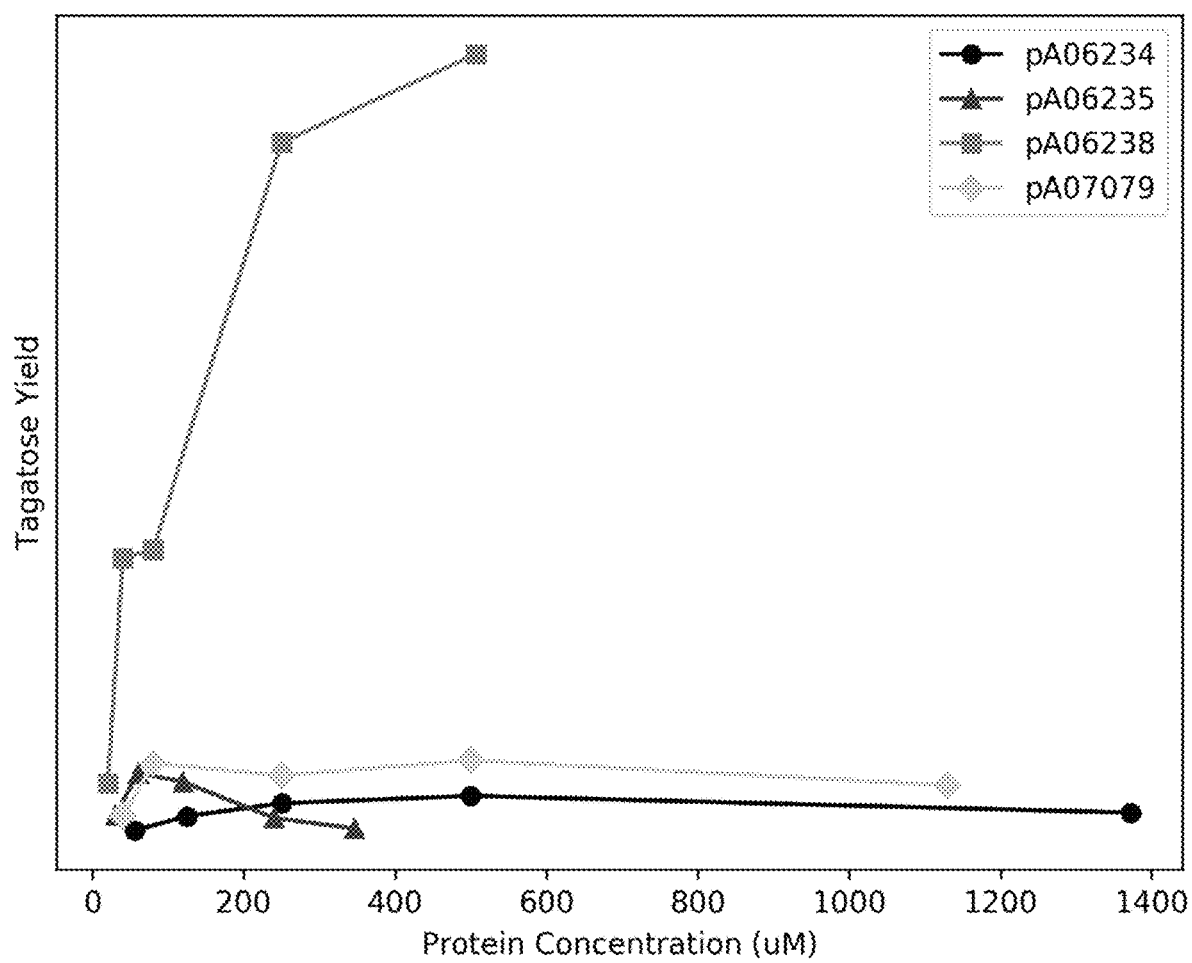
FIG. 10 depicts the effect of protein concentration on tagatose yield for 4 FC4Es

The effect of protein concentration was determined for FC4Es pA06234, pA06235, pA06238 and pA07079. Purified protein was obtained as in Example 2-1. The protein was then concentrated using Vivaspin 6, 5 kDa molecular weight protein concentrators. Five different dilutions of each FC4E was reacted with 1.9 M fructose in 20 mM $KPO_4$, 50 mM NaCl, 300 uM $CoCl_2$, pH 7.5 at 60° C. for 20 minutes. The conversion of fructose to tagatose was measured as in Example 2-2. The relative yield for the different protein concentrations is shown in FIG. 10.

Figure 11:
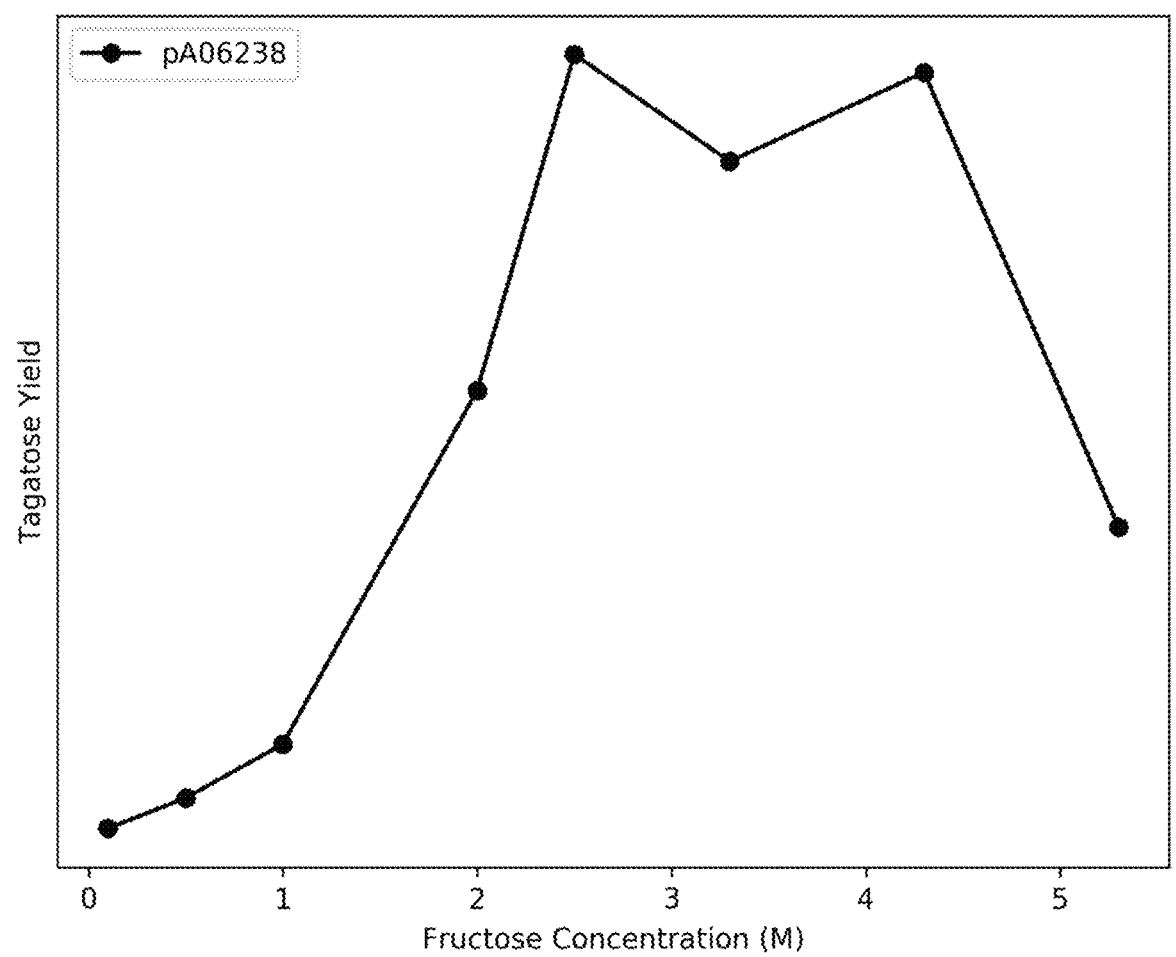
FIG. 11 depicts the impact of fructose concentration on tagatose yield for the FC4E, pA06238.

The effect of substrate concentration on fructose to tagatose conversion was measured for pA06238. Purified protein was obtained as in Example 2-1. pA06238 was reacted with 50 mM-2.8 M fructose in 20 mM $KPO_4$, 50 mM NaCl, 300 uM $CoCl_2$, pH 7.5 for 20 minutes at 60° C. The conversion of fructose to tagatose was measured as in Example 2-2. The relative tagatose yield for the tested sugar concentrations is shown in FIG. 11.

Example 6 Thermostability of pA06238

Figure 12:
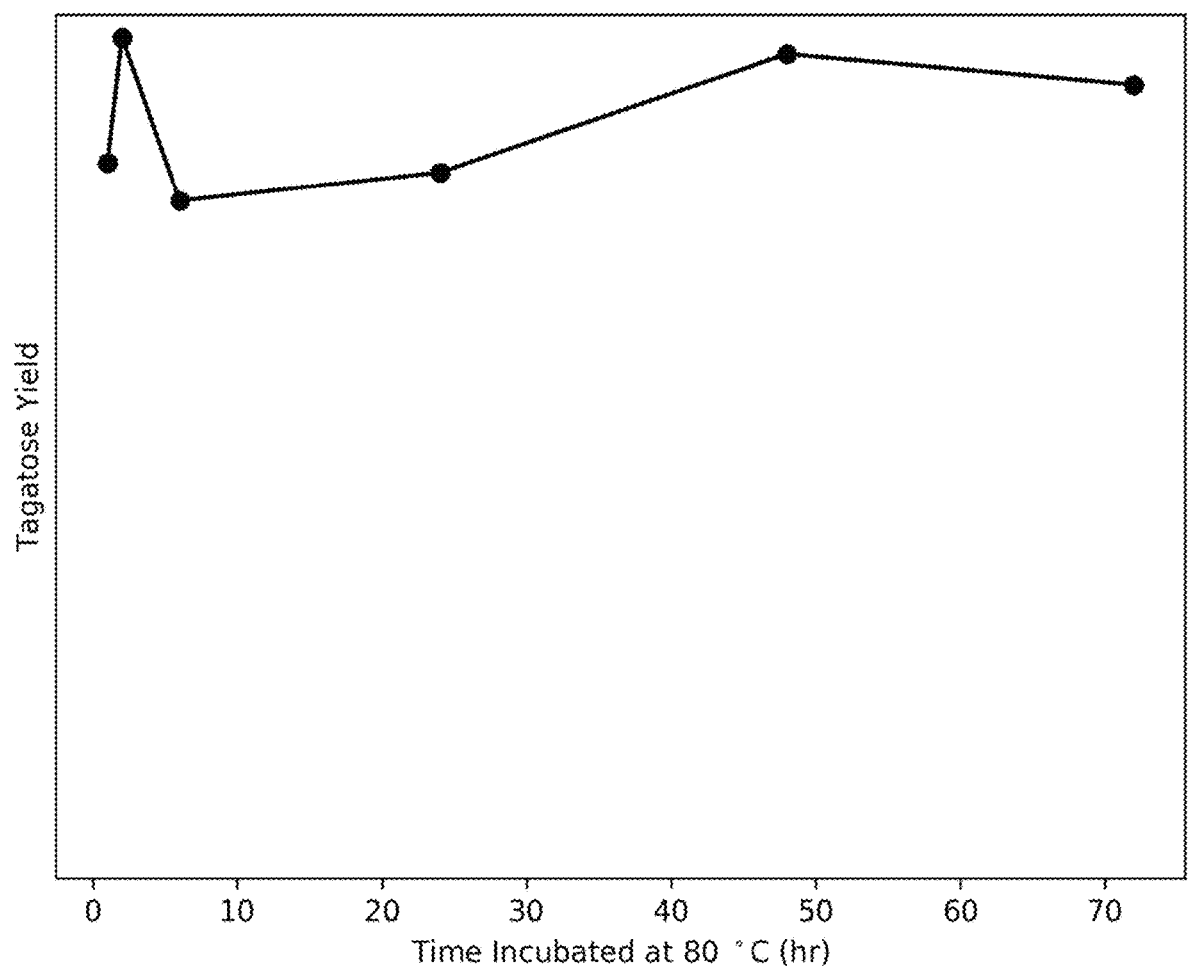
FIG. 12 depicts the effect of preincubating pA06238 at 80° C. for different amounts of time on tagatose yield.

An industrially useful enzyme will likely need to operate at sustained elevated temperatures. Example 4 demonstrates that pA06238 is stable when incubated at 60° C. for a day. To further investigate the thermostability of pA06238, the lifetime of pA06238 at 80° C. was investigated. Purified protein was obtained as in Example 2-1. pA06238 was incubated at 80° C. for 0-72 hours. Following incubation, the enzyme was reacted with 1.9 M fructose in 20 mM $KPO_4$, 50 mM NaCl, 300 uM $CoCl_2$, pH 7.5 for 20 minutes at 60° C. The conversion of fructose to tagatose was measured as in Example 2-2. The relative tagatose yield for the tested sugar concentrations is shown in FIG. 12. After 3 days incubation, there was not a statistically significant loss of activity compared to the early timepoints.

Example 7 Improved Expression of pA06238 Through Coding Sequence Optimization

Figure 13:
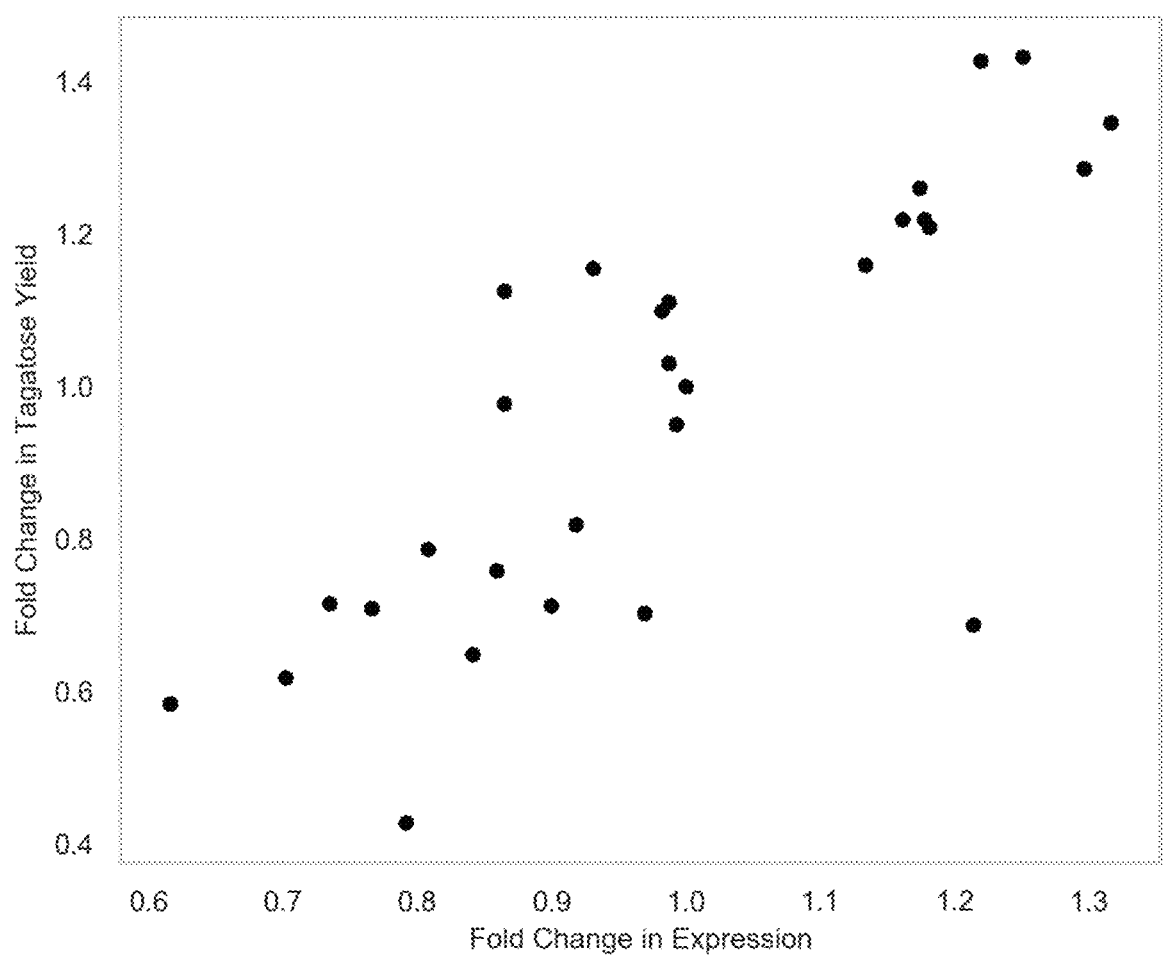
FIG. 13 depicts the fold change in expression and activity for 30 DNA optimized variants of pA06238.

We used our in-house DNA optimization software, Scribe™, to improve expression of pA06238. Thirty optimized polynucleotide sequences that code for the pA06238 amino acid sequence inserted in the pARZ4 expression vector were ordered from Twist Bioscience. The plasmids were transformed into NEBT7EL and the FC4Es were expressed and purified as in Example 2-1. Purified enzyme was reacted in buffer (20 mM $KPO_4$, 50 mM NaCl, 300 uM $CoCl_2$, pH 7.5) with 1.9 M fructose at 60° C. for 24 hours. To detect the formation of tagatose, reaction assays were diluted 20-fold with water. Plates were sealed and placed into a Waters AQUITY-H UPLC system consisting of an FTN samples manager, RI and UV detector. Separation of tagatose from fructose was conducted on an Agilent Hi-plex Pb 150×4.0 mm column (p/n PL1115-9999) with 100% water at 85° C. at a flow rate of 0.45 ml/min. Quantification was done using the RI detector channel. The purified protein yield and corresponding enzyme activity for the 30 optimized polynucleotide sequences compared to the parent pA06238 (square) is shown in FIG. 13. The most improved variant improved expression by 1.32-fold with a corresponding 1.35 fold improvement in tagatose yield.

Example 8 Immobilization of pA06238 on Commercially Available Supports 8-1. Enzyme Immobilization Resins The FC4E pA06238 enables a one-step enzymatic process to convert fructose to tagatose. An example biocatalytic process for making tagatose from fructose involves the use of immobilized FC4E in a fixed bed reactor or fluidized bed reactor. We successfully demonstrated the immobilization of pA06238 on several commercially available supports.

Enzyme immobilization resins were purchased from Chiralvision (IB-ADS-1, IB-ADS-2, IB-ADS-3, IB-ADS-4, IB-ANI-1, IB-ANI-2, IB-ANI-3, IB-ANI-4, IB-CAT-1, IB-COV-1, IB-COV-2, IB-COV-3) and Purolite (ECR1030M, ECR1090F, ECR1504, ECR1640, ECR8204F, ECR8209F, ECR8285, ECR8309F, ECR8409F, ECR8806F). These resins vary in composition (methacrylate, styrene or polyacrylic) as well as functional group (epoxy, amino, octadecyl, tertiary amine, quaternary amine, carboxylic ester, phenyl, sulphonic, or no functional group).

Figure 14:
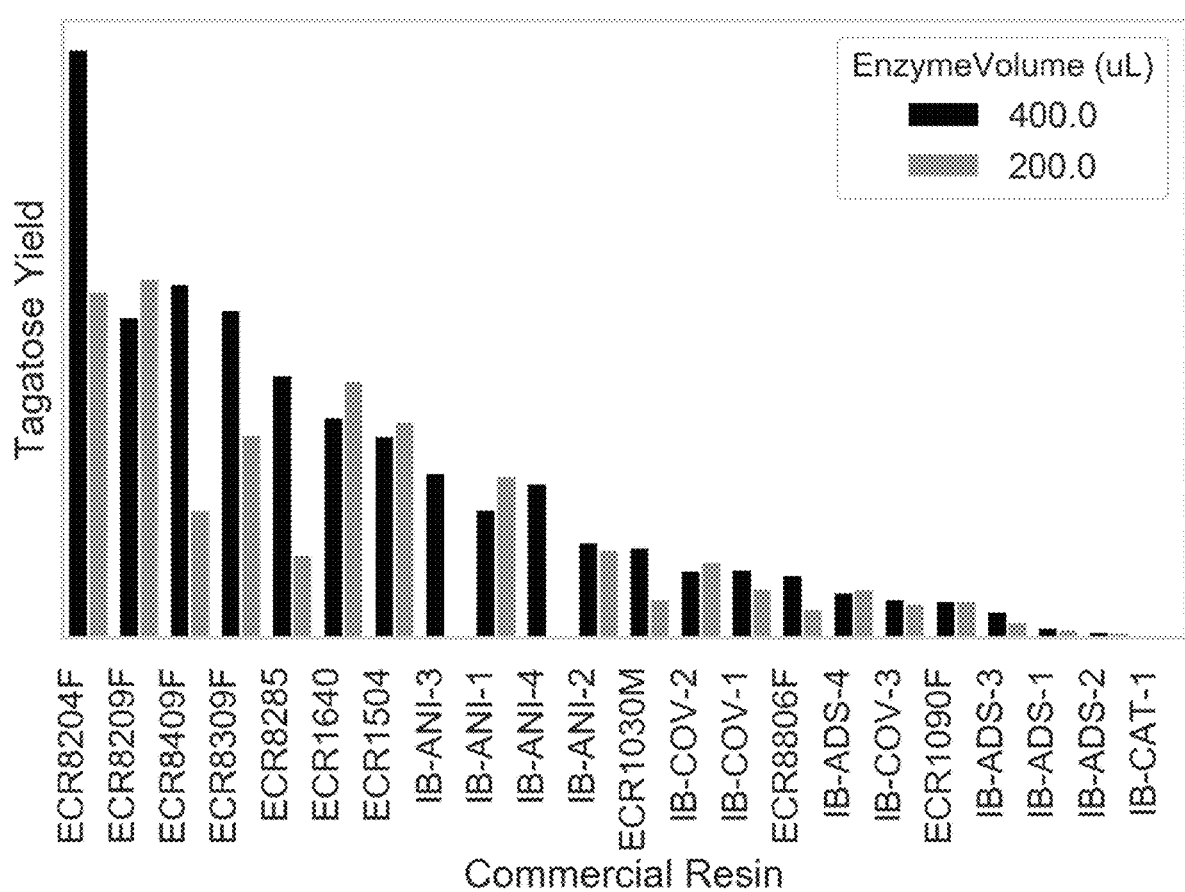
FIG. 14 depicts the fructose to tagatose yield of pA06238 immobilized on 22 commercially available resins.

The standard protocol for each resin from each company was used to immobilize pA06238 onto 100 mg resin. Two different volumes of enzyme (400 uL and 200 uL) were incubated with resin at room temperature to immobilize the enzyme onto the support. After incubation, the immobilized enzyme was washed five times with either water (Chiralvision) or buffer (Purolite). The immobilized enzyme was reacted with 1 M fructose in buffer at 60° C. for 20 minutes. The relative activity obtained for each support is shown in FIG. 14.

8-2. Metal Chelating Resins

Since pA06238 contains a hexahistidine tag, the enzyme should immobilize onto loaded metal chelating resins through a metal-hexahistidine tag interaction. The following commercial metal chelating resins were obtained to test enzyme immobilization: Ni-NTA agarose (Qiagen), Nuvia IMAC (Bio-Rad), S930 plus (Purolite), S940 (Purolite), S950 (Purolite), Lewatit MDS TP 208 (Lanxess), Lewatit MDS TP 260 (Lanxess), Lewatit MDS TP 260 (Lanxess), Relite MAC5 (Mitsubishi), Relite MAC1 (Mitsubishi), DIAION CR11 (Mitsubishi), DIAION CR20 (Mitsubishi), Amberlite IRC748 (Dow), and Amberlite IRC747 (Dow). The metal chelating resins utilize one of the following functional groups for metal binding: nitrilotriacetic acid (NTA), iminodiacetic acid (IDA), aminophosphonic acid (AMPA), polyamine, or carboxylic acid. The NTA resins were pre-loaded with nickel. For the remaining resins, copper was loaded onto the resin by incubating 100 mg of resin with 400 uL of 200 mM $CuSO_4$ followed by washing with 100 mM sodium acetate. To immobilize pA06238, all resins were washed with buffer (20 mM $KPO_4$, 50 mM NaCl, 300 uM $CoCl_2$, pH 7.5) and 8 mg of protein was incubated with 100 mg for 18 hours with mixing and let stand for 20 hours at room temperature. Immobilized enzyme was washed with buffer to remove unbound protein, and then assayed for fructose to tagatose conversion by reacting with 1 M fructose for 20 minutes at 60° C. Four metal chelating resins had detectable activity, but all were lower than the best enzyme immobilization resins from Example 8-1 (Table 4).

TABLE 4

Relative activity of pA06238 immobilized on metal chelating resins compared to ECR8204F

| Resin | Percent of ECR8204F Yield |
| --- | --- |
| Qiagen Ni-NTA | 18.1% |
| Nuvia IMAC | 16.0% |
| Amberlite IRC747 | 6.7% |
| DIAION CR20 | 5.6% |

Example 9 Conversion of Fructose to Tagatose in a Fixed Bed Reactor

NEBT7EL-pA06238 was grown on LB with 50 μg/ml kanamycin. A 600 ml culture of TBkan5 was inoculated with NEBT7EL-pA06238 and incubated overnight at 37° C. at 200 rpm. The next morning, a 10 L fermentor was prepared with 9.5 L of TB and then inoculated with 500 ml of the overnight culture. The culture was grown at 37° C. The pH was maintained at 6.2 with NaOH and the $dO_2$ was maintained ≥20%. After 2 hours of growth, the temperature was dropped to 25° C. The culture was grown for an additional 1 hour with the $OD_{600}$ around 7. IPTG was added to a final concentration of 1 mM and $CoCl_2$ was added to 25 μM. Additional $CoCl_2$ was added 1 and 2 hours after induction to bring the final concentration to 300 μM. The cells were grown for 20 hours at which point the fermentor was chilled to 10° C. and the cells were harvested by centrifugation. The cell pellet was stored at −80° C. until use.

The cell pellet from the fermentation was lysed by stirring in buffer with lysozyme and DNAse. Cell debris was removed by centrifugation and the supernatant was filtered through a 0.45 micron filter. Filtered supernatant was incubated with Ni-NTA agarose resin and then enzyme was eluted with imidazole. Purified FC4E pA06238 was immobilized onto 5.25 grams of ECR8204F resin using the standard published protocol from Purolite.

Figure 15:
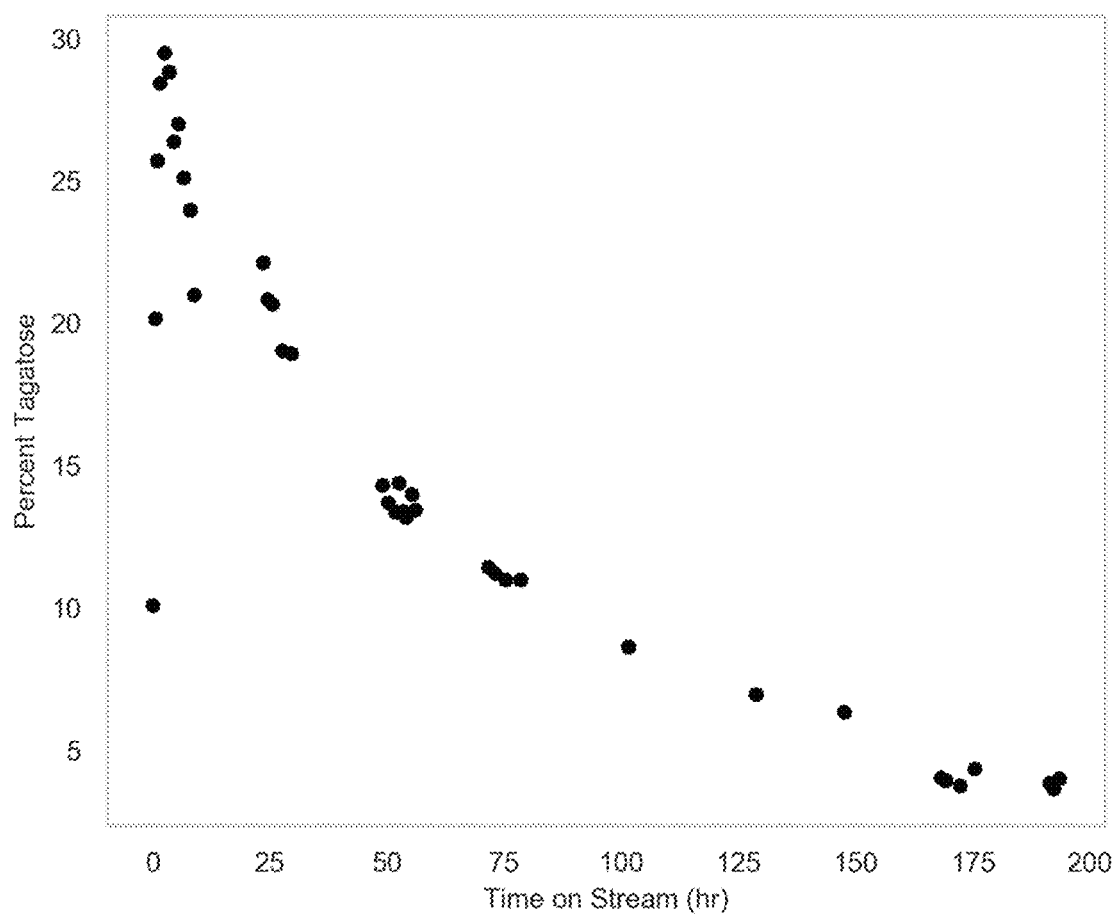
FIG. 15 depicts the percent tagatose converted from fructose over time from a fixed bed reactor packed with immobilized pA06238.

The immobilized enzyme was loaded into a 11×300 mm glass fixed bed reactor and run for approximately 200 h at constant temperature (60° C.) with a constant feed composition of 30 wt % fructose+70 wt % aqueous buffer solution (20 mM $KPO_4$, 50 mM NaCl, 300 uM $CoCl_2$). Feed rate was held constant at 140 uL/min throughout the run. The fixed bed reaction reached a maximal conversion of approximately 30% tagatose and had a half-life of ~50 hours (FIG. 15).

Example 10 Simulated Moving Bed Separation of Tagatose from a Mixed Sugar Solution Eight 25 mm×300 mm glass, jacketed chromatography columns were loaded with Dowex™ monosphere 99 Ca/320 resin and connected to a temperature control system including a recirculating hot water system (Polyscience, AP20S150-A11B) and electrical heat-loss compensation capable of temperature control to within ±1° C. The columns were plumbed in a 3-zone simulated moving bed configuration using a Semba Biosciences Octave chromatography system (SMB unit). A degassed feed sugar solution of 10 wt % tagatose, 20 wt % fructose and 70 wt % purified water was metered into the SMB unit via a dual-piston positive displacement pump (Octave 100) including pre- and post-filters and pulse-dampening to ensure smooth continuous flow at specified volumetric flow rates. The eluent feed to the system was a degassed purified water solution, similarly, fed to the SMB unit using a larger dual-piston positive displacement pump (Octave 300) including pre- and post-filters and pulse-dampening. At steady-state, a smaller extract stream was continuously withdrawn from the unit using a third dual-piston positive displacement pump (Octave 100), while the larger raffinate stream flowed from the unit via a back-pressure control valve. Product rates were monitored intermittently by manual volumetric measurement.

A range of experiments were performed to demonstrate purification of tagatose in the extract stream. In Condition 1 the SMB separation was performed on 1 L of the degassed sugar feed solution, collecting 3.6 L of extract and 12.2 L of raffinate over 24 h. Table 5 shows that a highly purified tagatose stream can be collected using SMB separation.

TABLE 5

Measured concentrations of tagatose and fructose during SMB Condition 1.

|  | Tagatose concentration, g/L | Fructose Concentration, g/L |
|---|---|---|
| Extract Stream | 33.35 | 0.25 |
| Raffinate Stream | 1.87 | 31.30 |

Example 11 Isothermal Batch Crystallization of Tagatose from a Mixed Sugar Solution A mixed sugar solution comprising 200 g tagatose, and 50 g fructose was solvated in 120 g water by gently heating the solution with rotary agitation using a rotary evaporator (Eyela, N-1200BS) to a temperature of 60° C. Isothermal batch crystallization was performed by pulling vacuum of the evaporation flask to a constant pressure of 100 mmHg, then slowly evaporating water from the flask under constant vacuum over a 270 min period. Once 20 ml of condensate had been collected, the experiment was paused briefly, 0.25 g of pure tagatose seed crystals were added to the flask, and then vacuum conditions were restored, and the evaporation was continued. Slow crystallization was observed. The experiment was continued until 80 ml condensate had been collected, after which the flask was quickly disconnected from the rotary evaporator and the slurry of mother liquor and crystals was quickly filtered via a Buchner funnel fitted with a cellulose filter. The collected crystals were washed with 62.5 g of ice-cold water, then dried under vacuum at 60° C. for 2 h. The final tagatose crystals contained 98.51 wt % tagatose and 1.49 wt % fructose, a significant improvement versus the feed mixture.

Example 12 Active Site Mutants Improve FC4E Activity 12-1. Active Site Mutants of pA06234

Active site mutants of pA06234 were generated to determine the impact of these residues on catalysis. For each mutant, primer pairs were designed to 1) open the parent CDS at the desired insertion point (omitting the codon intended to be replaced) and 2) split the plasmid backbone within the antibiotic selection marker. Polymerase chain reaction (PCR) then successfully generated two linear fragments from each plasmid. The new, desired codon was embedded in the forward primer of the first PCR. Primers were designed to also include flanking homology. Subsequent two-way flanking homology-based DNA assembly produced plasmids used to transform our standard cloning strain. After confirming DNA sequence by Sanger sequencing, sequence-perfect plasmids were used to transform NEBT7EL.

Figure 16:
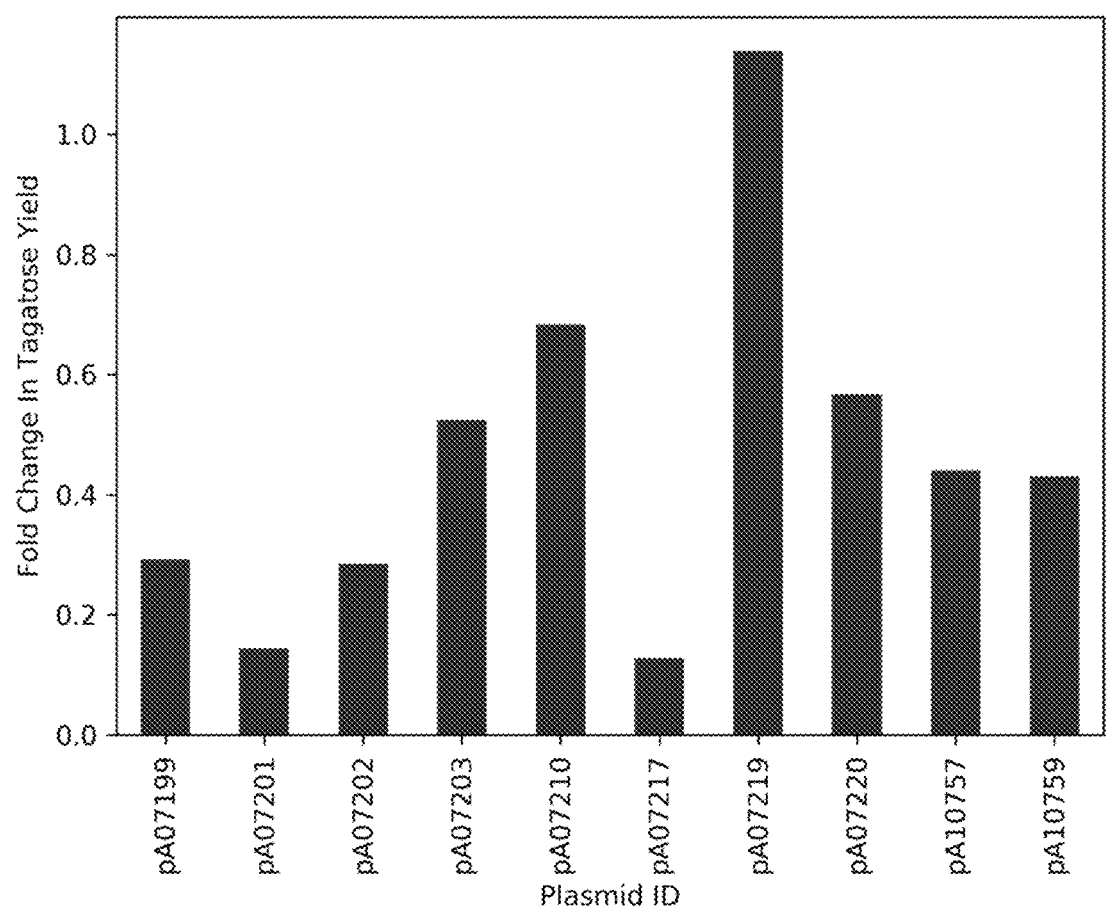
FIG. 16 depicts the fold change in fructose to tagatose conversion for active site mutants of pA06234.

FC4E active site mutants (SEQ ID NOs: 24-45) were expressed and purified as in Example 2-1. Purified enzyme was reacted with 1.9 M fructose in buffer (20 mM KPO$_4$, 50 mM NaCl, 300 uM CoCl$_2$) overnight at 60° C. Conversion of fructose to tagatose was measured as in Example 2-2 (FIG. 16). Promising active site mutants with tagatose conversion similar to or better than the parent were further investigated by reacting with fructose for 20 minutes. Four mutants with increased activity compared to the parent enzyme (pA06234) are shown in Table 6.

TABLE 6

| Plasmid ID | Mutation | Fold Increase in Tagatose Yield |
|---|---|---|
| pA07219 | Y361A | 2.14 |
| pA07210 | E178A | 2.14 |
| pA07203 | Y64F | 1.40 |
| pA07202 | Y64A | 1.18 |

12-2. Transferring pA06234 Active Site Mutations into pA06238

The native FC4Es (SEQ ID NOs: 1-23, 321-373) are sufficiently similar (FIG. 17) that beneficial mutations in one enzyme can be transferred to the corresponding position in another FC4E enzyme and have correspondingly beneficial impacts. We demonstrate this by transferring the top three mutations from Example 12-1 (Y64F, E178A, Y361A) into the pA06238 sequence (Y53F, D167A, Y340A; SEQ ID NO: 231). The polynucleotide sequence for SEQ ID NO: 231 was ordered from Twist Bioscience. The plasmid was transformed, and the protein was expressed and purified as in Example 2-1. The purified enzyme was reacted with 1.9 M fructose in buffer (20 mM KPO$_4$, 50 mM NaCl, 300 uM CoCl$_2$) for 24 hours at 60° C. The mutant enzyme, SEQ ID NO: 231, had a 1.4-fold improvement in tagatose conversion compared to the parent enzyme, pA06238.

12-3. Active Site Mutants of pA06238

Forty-two active site residue positions in pA06238 were chosen for site-saturation mutagenesis to create a library of pA06238 mutants. Mutant plasmids were generated similar to Example 12-1, except that primers were used that encoded all amino acids at the specified mutant residue position, and clones were selected for use without sequence verification.

Figure 18:
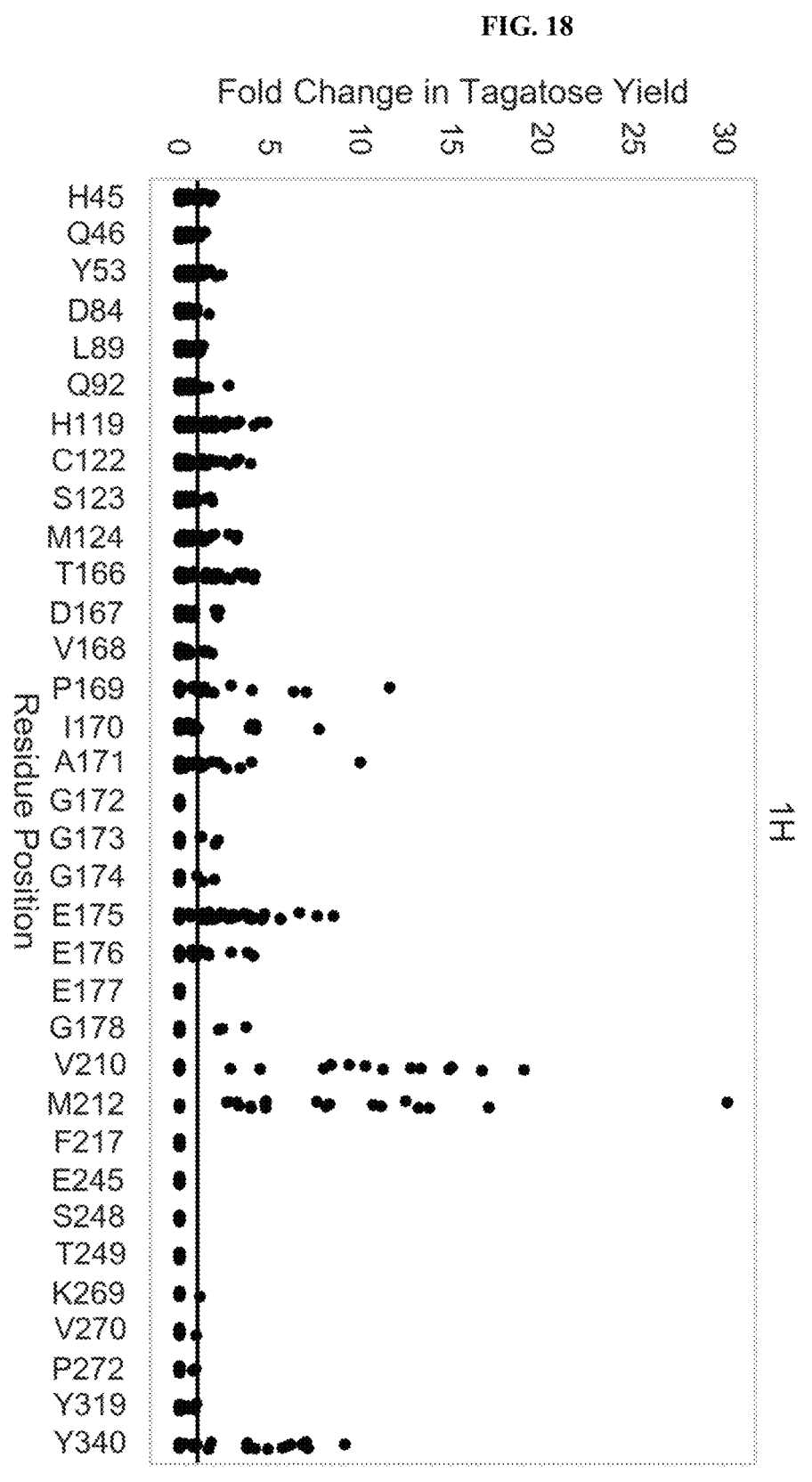
Figure 19:
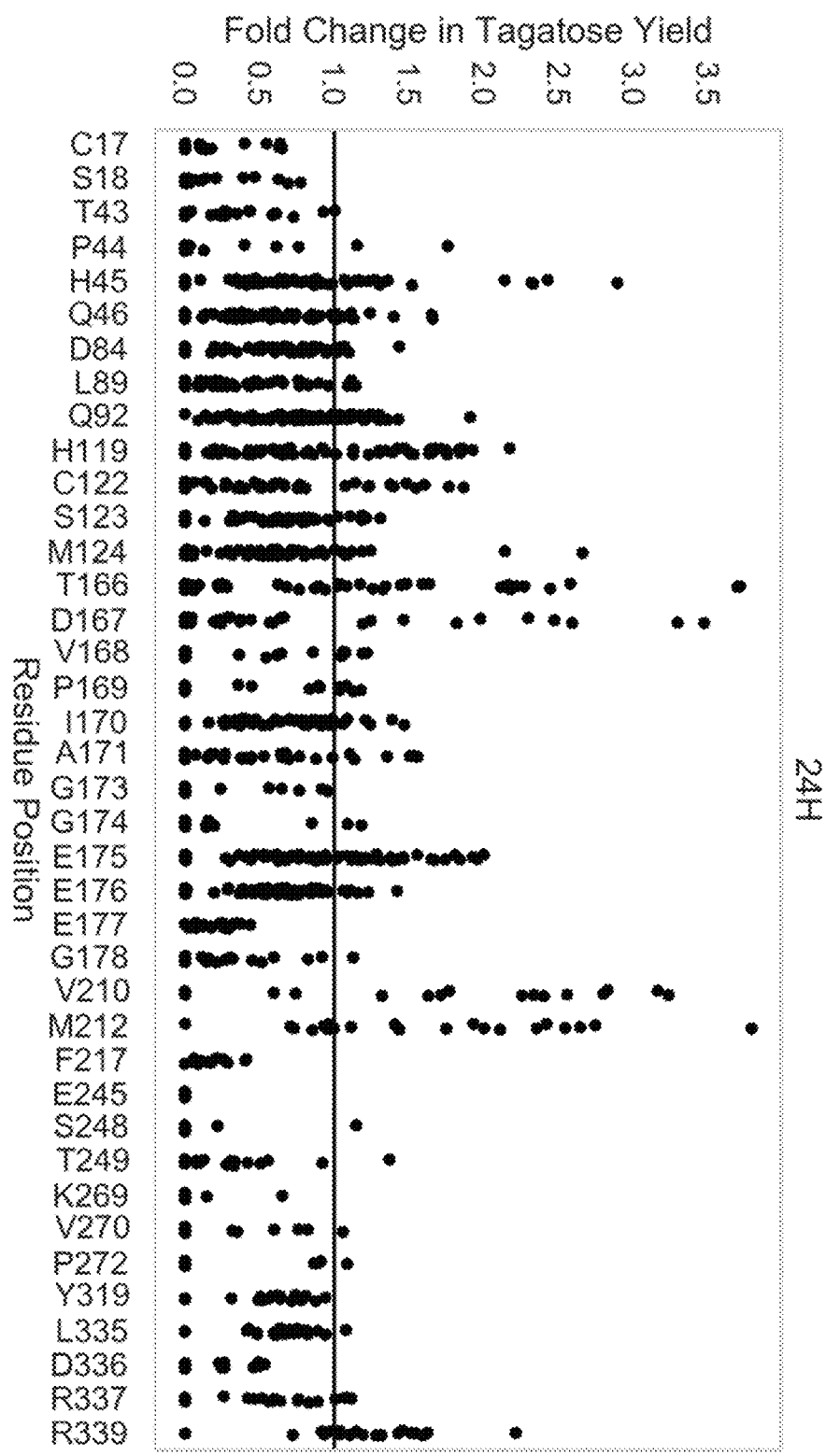
FIG. 19 depicts the fold change in fructose to tagatose conversion for members of the FC4E active site mutant library (reaction time 24 hours).

FC4Es from the mutant library were expressed and purified similar to Example 2-1. Purified enzyme was reacted with 1.9 M fructose in buffer (20 mM KPO$_4$, 50 mM NaCl, 300 uM CoCl$_2$, pH 7.5) at 60° C. for 1 and 24 hours. Conversion of fructose to tagatose was measured as in Example 7. Fold increase in percent tagatose conversion for each tested mutant is shown in FIG. 18 (1 hour data) and FIG. 19 (24 hour measurements). The following wild-type residue positions had mutant library members that showed increased conversion of tagatose compared to their parent FC4E: T43, P44, H45, Q46, Y53, D84, L89, Q92, H119, C122, S123, M124, T166, D167, V168, P169, I170, A171, G173, G174, E175, E176, G178, V210, M212, S248, T249, K269, V270, P272, L335, R337, R339, Y340. The top mutants from the library were sequenced and are included here as SEQ ID NOs: 371-444.

Example 13 Computational Design of pA06238 to Improve Expression and Stability

Computational design of pA06238 guided by native sequence alignment was used to improve protein expression and stability. In order for a given amino acid at a specific residue position to be allowed in the final design, it had to pass two filters: one based on native sequence alignment and one based on computational modeling. A position-specific scoring matrix (PSSM) was created from a native sequence alignment. Two different alignments were used: 1) aligned sequences were only from thermophilic organisms and 2) aligned sequences were allowed from any organism. Any amino acid with a positive score in the PSSM passed the first filter. For each passing amino acid, the Archytas™ protein design software was used to predict if mutating to the given amino acid was predicted to have a $\Delta\Delta G$ below a given cutoff. Several cutoffs, −2.5, −2.0, −1.5, −1.0, −0.5, were used to select the final designs. All amino acids that passed both filters were combined in a final computational design. Homology models of pA06238 built with Archytas™ were used as input for both the $\Delta\Delta G$ calculations and final computational designs.

Figure 21:
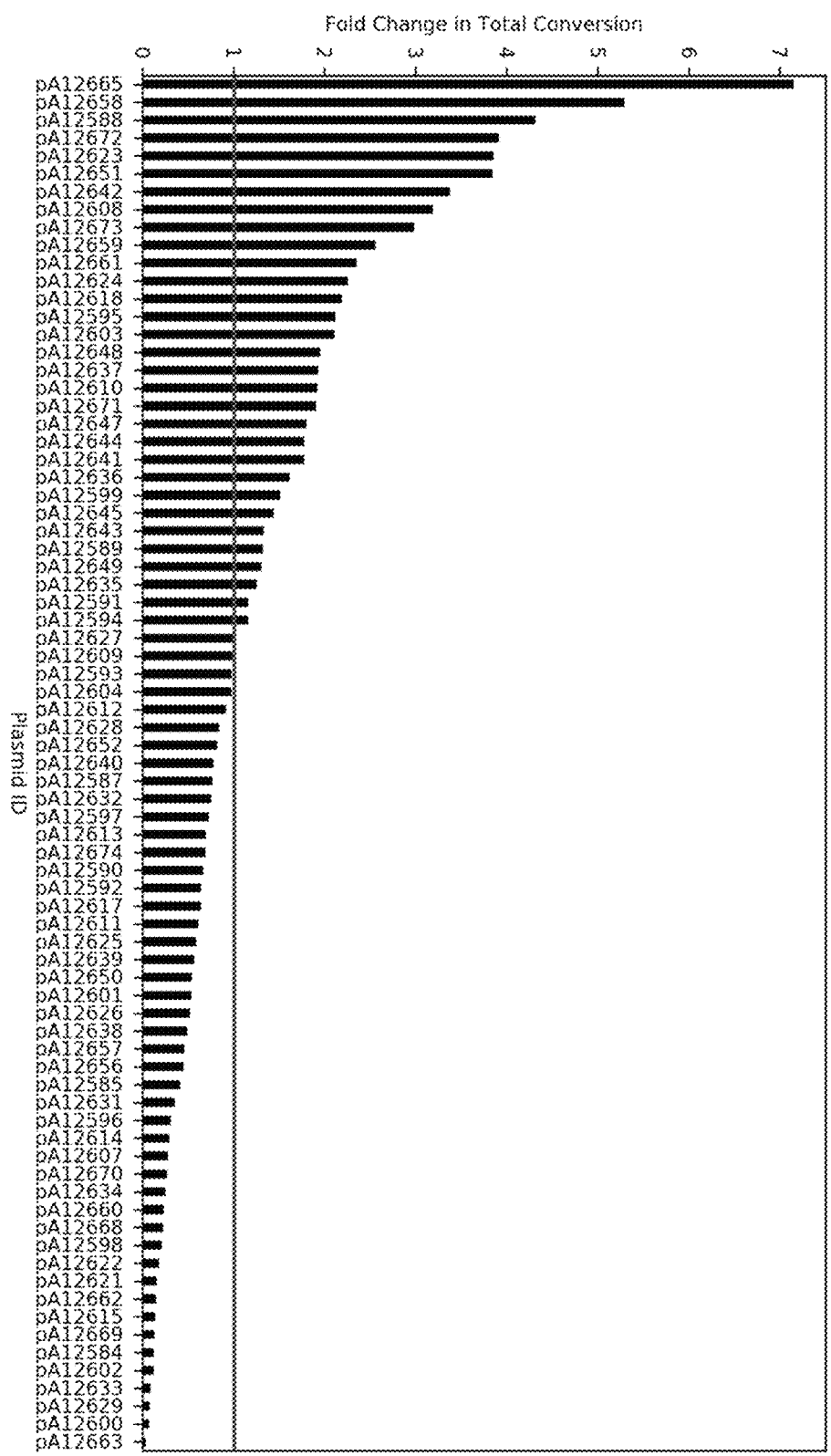
FIG. 21 depicts the fold change in total conversion (amount of expressed protein multiplied by the tagatose yield from a standard amount of enzyme) for the FC4E computational designs.

Ninety two designed enzymes were chosen for characterization (FIG. 20). The number of mutations per design ranged from 2-47 with an average of 15 mutations per design. Mutations occurred at 138 residue positions within pA06238. A sequence alignment of the designs with all mutations highlighted is shown in FIG. 20. Polynucleotide sequences for the 92 designed enzymes (SEQ ID NOs: 46-136) were ordered from Twist Bioscience. The plasmids were transformed, and the protein was expressed and purified as in Example 2-1. The purified FC4Es were reacted with 1.9 M fructose in buffer (20 mM $KPO_4$, 50 mM NaCl, 300 uM $CoCl_2$) for 24 hours at 60° C. The fold change in total conversion (total purified protein multiplied by percent conversion to tagatose for a standard amount of enzyme) is shown in FIG. 21.

Example 14 Computational Design of pA06238 for Increased Stability

Figure 24:
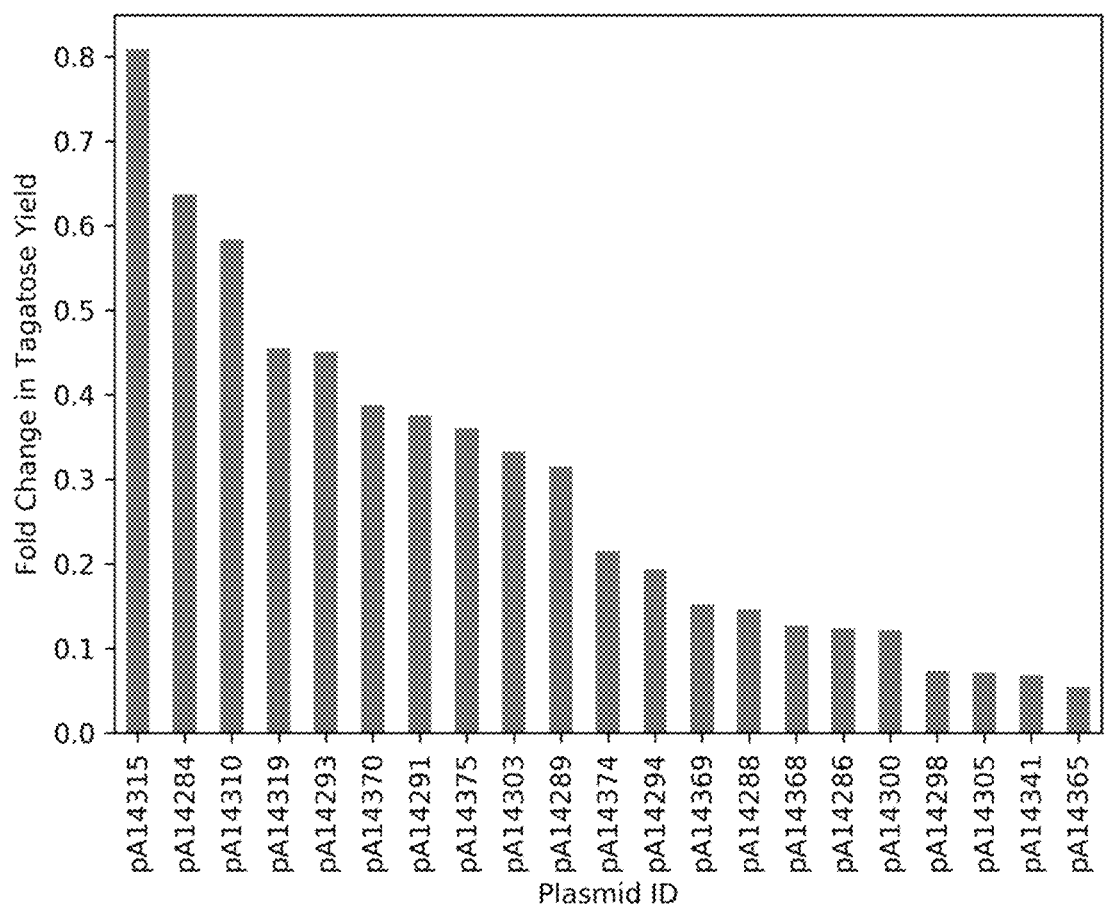
FIG. 24 depicts the fold change in tagatose yield for a subset of the FC4E computational designs from Example 14.

Enzyme inactivation has been observed when enzymes are exposed to aldehydes (Jennewein et al., 2006; Lorenzo et al., 2007). Lysines and to a lesser extent cysteines are particularly susceptible to modification by aldehydes, causing enzyme inactivation. The Archytas™ design software was used to design mutants of pA06238 with a reduced number of exposed lysine and cysteine residues. 184 designed lysine mutant enzymes were chosen to be experimentally characterized. Half of the designed mutants only mutated lysine and cysteine residues (SEQ ID NOs: 137-231; FIG. 22), and the other half allowed mutations surrounding the lysine and cysteine positions (SEQ ID NOs: 232-320; FIG. 23). The mutants were ordered from Twist Bioscience and tested for FC4E activity. The plasmids were transformed, and the enzymes were expressed and purified as in Example 2-1. The purified FC4Es were reacted with 1.9M fructose in buffer (20 mM $KPO_4$, 50 mM NaCl, 300 uM $CoCl_2$) for 24 hours at 60° C. The fold change in tagatose conversion for a subset of lysine mutants is shown in FIG. 24.

INCORPORATION BY REFERENCE

The entire disclosure of each of the patent documents and scientific articles referred to herein is incorporated by reference for all purposes.

EQUIVALENTS

The invention may be embodied in other specific forms without departing from the spirit or essential characteristics thereof. The foregoing embodiments are therefore to be considered in all respects illustrative rather than limiting on the invention described herein. Scope of the invention is thus indicated by the appended claims rather than by the foregoing description, and all changes that come within the meaning and the range of equivalency of the claims are intended to be embraced therein.

SEQUENCE LISTING (444 sequences)

SEQ ID NO: 1 - protein, 453 aa, Caldithrix abyssi
MSLHPLNKLIERHKKGTPVGIYSVCSANPFVLKAAMLQAQKDQSLLLIEATSNQVDQFGGYTGMRPEDFKTMTLELAAENNYDPQGLILGGDHLGPNRWTKLSASRAMDYAREQIAAYVKAGFSKIHLDATMPLQNDATDSAGRLPVETIAQRTAELCAVAEQTYRQSDQLFPPPVYIVGSDVPIPGGAQEALNQIHITEVKEVQQTIDHVRRAFEKNGLEAAYERVCAVVVQPGVEFADQIVFEYAPDRAAALKDFIESHSQLVYEAHSTDYQTAPLLRQMVKDHFAILKVGPALTFALREAIFALAFMEKELLPLHRALKPSAILETLDQTMDKNPAYWQKHYGGTKEEVRFAQRFSLSDRIRYYWPFPKVQKALRQLLKNLQQISIPLTLVSQFMPEEYQRIRQGTLTNDPQALILNKIQSVLKQYAEATQIQNSLTFTQNQNSLAMERL

SEQ ID NO: 2 - protein, 429 aa, Anaerolinea thermophila
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 3 - protein, 434 aa, Thermoanaerobacterium thermosaccharolyticum
MAKEHPLKELVNKQKSGISEGIVSICSSNEFVIEASMERALTNGDYVLIESTANQVNQYGGYIGMTPIEFKKFVFSIAKKVDFPLDKLILGGDHLGPLIWKNESSNLALAKASELIKEYVLAGYTKIHIDTSMRLKDDTDFNTEIIAQRSAVLLKAAENAYMELNKNNKNVLHPVYVIGSEVPIPGGSQGSDESLQITDAKDFENTVEIFKDVFSKYGLINEWENIVAFVVQPGVEFGNDFVHEYKRDEAKELTDALKNYKTFVFEGHSTDYQTRESLKQMVEDGIAILKVGPALTFALREALIALNNIENELLNNVDSIKLSNFTNVLVSEMINNPEHWKNHYFGDDARKKFLCKYSYSDRCRYYLPTRNVKNSLNLLIRNLENVKIPMTLISQFMPLQYDNIRRGLIKNEPISLIKNAIMNRLNDYYYAIKP

SEQ ID NO: 4 - protein, 446 aa, Thermoanaerobacter thermohydrosulfuricus
MNTEHPLKNVVKLQKKGIPIGIYSVCSANEIVIQVAMEKALSMDSYVLIEATANQVNQYGGYTNMKPIDFRDFVYSIAKRINFPENRIILGGDHLGPLPWKNQQAKKAMEEAKELVKQFVMAGFTKIHVDTSMLLGDDNINIKLDTETIAERGAILVSVAERAFEELKKFNPYALHPVYVIGSEVPVPGGSQKENNNEIQVTKPTDFEETVEVYKSTFYKYGLGNAWEDVVAVVVQAGVEFGVEDIHEYDHQQAENLVSALKKYPNLVFEAHSTDYQPAKLLKEMVRDGFAILKVGPELTFALREGLFALNIIEKELFKDNHDIEMSNFIDILDTAMLNNPKYWEQYYYGDDNKIRIARKYSYSDRCRYYLIENEVRASMSRLFKNLTNVEIPLTLISQYMPIQYEKIRMGLLKNDPENLVKDKIGNCIDKYLYATNPTSGEFKLI

SEQ ID NO: 5 - protein, 429 aa, Caldicellulosiruptor kronotskyensis
MSPQNPLIGLFKNREKEFKGIISVCSSNEIVLEAVLKRMKDTNLPIIIEATANQVNQFGGYSGLTPSQFKERVIKIAQKVDFPLERIILGGDHLGPFVWRDQEPEIAMEYAKQMIKEYIKAGFTKIHIDTSMPLKGENSIDDEIIAKRTAVLCRIAEECFEKISINNPYITRPVYVIGADVPPPGGESSICQTITTKDELERSLEYFKEAFKKEGIEHVFDYVVAVVANFGVEFGSDEIVDFDMEKVKPLKELLAKYNIVFEGHSTDYQTKENLKRMVECGIAILKVGPALTFTLREALVALSHIEEEIYSNEKEKLSRFREVLLNTMLTCKDHWSKYFDENDKLIKSKLLYSYLDRWRYYFENESVKSAVYSLIGNLENVKIPPWLVSQYFPSQYQKMRKKDLKNGAADLILDKIGEVIDHYVYAVKE

SEQ ID NO: 6 - protein, 408 aa, Dictyoglomus turgidum
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 7 - protein, 408 aa, Caldilinea aerophila
MSTLRHIILRLIELREREQIHLTLLAVCPNSAAVLEAAVKVAARCHTPMLFAATLNQVDRDGGYTGWTPAQFVAEMRRYAVRYGCTTPLYPCLDHGGPWLKDRHAQEKLPLDQAMHEVKLSLTACLEAGYALLHIDPTVDRTLPPGEAPLVPIVVERTVELIEHAEQERQRLNLPAVAYEVGTEEVHGGLVNFDNFVAFLDLLKARLEQRALMHAWPAFVVAQVGTDLHTTYFDPSAAQRLTEIVRPTGALLKGHYTDWVENPADYPRVGMGGANVGPEFTAAEFEALEALERREQRLCANRKLQPACFLAALEEAVVASDRWRKWLQPDEIGKPFAELTPARRRWLVQTGARYVWTAPKVIAAREQLYAHLSLVQADPHAYVVESVARSIERYIDAFNLYDAATLLG

SEQ ID NO: 8 - protein, 420 aa, Rhodothermus marinus
MQAQALLTVPFDRVATHARGFVGWVAELLQGPLAYQHTLLAVCPNSEAVTRAALEAAAEANAPLLFAATLNQVDLDGGYTGWTPATLARFVADELARLDLHIPVVLGLDHGGPWKKDLHARNRLSFEETFQAVLRAIEACLDAGYGLLHLDPTVDLELSPGTPVPIPRIVERSVALLRHAETYRLRRNLPPVAYEVGTEEVGGGLQAEARMAEFLDRLWTALDREGLPHPVFVVGDIGTRLDTRTFDFERARRLDALVRRYGALIKGHYTDDVDRLDLYPKAGIGGANVGPGLAAIEFEALEALVEEARRRGLSVTFDQAIRRAVVESGRWTKWLQPEEKGQPFDALDPERQRWLVATGSRYVWTHPAVLQARRELYEALAPWLDADAFVRTRIKARLMDYFRAFNLIHFNERLQAFLPE

SEQ ID NO: 9 - protein, 401 aa, Methanohalobium evestigatum
MTDEDFEPICEISEQFRNYCNQMLESEYDPKPSKYIFNILQNQKTIVMAANPRIGLVTRGILRAAKDADAPIILELARSECNLENGYTGLYPSDFSEQCYQAAKDVGYDIWALHADHIGIKKGDREDIEKTKELVKAQIDAGYTSFAIDASHLFNFQGGDLREELKDNIDATTEIAKFIEEQMDDREYGLEVEVGEIGREDEHGRVLTNPEEAVTFIKALNENGVYPQVLAIANGSAHGNTYDSQGRLIEQVSIDIPQTIKVAQALKENNLKVRIAQHGITGTPRELIHDHFPHGEIIKGNVGTFYMNLVWDAFKLFEPELYNDIWNWTVENYKQKSPDKTDSEIFGKYSKFAIKQFFDRIYSVNEDTKRAIDAMAYAETLYFLKSFNAERTASIVRDGIK

SEQ ID NO: 10 - protein, 343 aa, Thermoanaerobacter thermohydrosulfuricus
MNTEHPLKNVVKLQKKGIPIGIYSVCSANEIVIQVAMEKALSMDSYVLIEATANQVNQYGGYTNMKPIDFRDFVYSIAKRINFPENRIILGGDHLGPLPWKNQQAKKAMEEAKELVKQFVMAGFTKIHVDTSMFLGDDNINIKLDTETIAERGAILVSVAERAFEELKKSNPYALHPVYVIGSEVPVPGGSQKENNNEIQVTKPADFEETVEVYKSTFYKYGLGNAWEDVVAVVVQPGVEFGVENIHEYDHQQAENLVSALKKYPNLVFEAHSTDYQPAKLLKEMVRDGFAILKVGPELTFALREGLFALNIIEKELFKDNHDIEMSNFIDILDTAMLNNPKY

SEQ ID NO: 11 - protein, 435 aa, Clostridium cavendishii
MQRNYLLDIVEAQNNGIHKGIYSACSANEYVIEAAMERAKNTNEYVLIEATANQVNQYGGYTGMKPIDFKNFVYDIADKINFDKDKIILGGDHLGPLTWSKETEKEAMAKSHELVKEYVMAGFTKIHLDTSMYLADDDRSKKLATEVIARRGAELCKTAEESFKALKERNSMAVAPVYIVGSEVPIPGGIQDEEEGIQVTKPEDFLETVKVYKAEFKDKGIDEVWNRVIGVVVQPGVEFGDESVHEYNREKAEKLVNSLRGVKGIVFEGHSTDYQTKTKLKEMVEDGIAILKVGPALTYGLREALFALNHIENEIFKYRADIKLSNFINVLETSMVEEPTHWKQHYHGDAEDIKYAMRYSYSDRCRYYMPTEAVNKAMNILIENLESVEIPLTIIDQYMPMQYKKIREGLIQNKPKELIKDRIGDYIDDYLYALR

SEQ ID NO: 12 - protein, 435 aa, Kosmotoga olearia
MKKHPLQDIVSLQKQGIPKGVFSVCSANRFVIETTLEYAKMKGTTVLIEATCNQVNQFGGYTGMTPADFREMVFSIAEDIGLPKNKIILGGDHLGPNPWKGQPSDQAMRNAIEMIREYAKAGFTKLHLDASMRLADDPGNENEPLNPEVIAERTALLCLEAERAFKESAGSLRPVYVIGTDVPPPGGAQNEGKSIHVTSVQDFERTVELTKKAFFDHGLYEAWGRVIAVVVQPGVEFGNEHIFEYDRNRARELTEAIKKHPNIVFEGHSTDYQTAKALKEMVEDGVAILKVGPALTFALREAFFALSSIEKELFYDTPGLCSNFVEVVERAMLDNPKHWEKYYQGEERENRLARKYSFLDRLRYYWNLPEVRTAVNKLITNLETKEIPLTLISQFMPMQYQKIRNGLLRKDPISLIKDRITLVLDDYYFATHPEC

SEQ ID NO: 13 - protein, 440 aa, Butyricicoccus pullicaecorum
MNHNPLKKIVELQKQGKNVGIYSVCSANGYVIEAALKRGKSDGSCVLIESTANQCDQNGGYTGMTPLDFKNFVLGIADKVGFDPKRLFLGGDHLGPLTFAGMDEAQAMENAEELIRHYVGAGFTKIHIDTSMKVASDDPNTRLSDETIAKRGARLARVAQDTYHKLLESDPDAIAPVYIVGSEVPIPGGAVGAVDQGVQVTKVEDFKNTVATFEKAFREQGLDEAWDNVIGVVVQPGVEEKDSGCTEYDREKAKDLMASIQEFPNLVFEGHSTDYQTKIKLRELVEDGVGILKVGPALTFAMREGMFALENIEKELIYGTDITPSGFQDALEAEMLKEGKHWRKHYQGTELELRMKRKYSFSDRCRYYMPTPAVEAAKERLISNLRTLGIPLNLLSQFMPIQYTKVREGLLVNDPVELVEDRIINTIDEYLYATHQKELL

SEQ ID NO: 14 - protein, 447 aa, Clostridium thermobutyricum
MLLKVKEHPIRELVNRYKNGENVGIFSVCTSNEYVIEAAMERVIDKDLDLLIESTANQVNQDGGYTGMQPKDFVNYVYKIADKVNFPKDRIILGGDHLGPLTWTKLVQEEAMEKAKVLIRDYVLAGFTKIHIDTSMPIYDDLEKGVFGDDLIAERAAILCNVAEIAYRELLKTNEDAIHPIYVVGSEVPVPGGVQAEEAEEEIENGIKVTRVEDFKNTVEVFKKKFKEHGVEEAFNYVVGVVVQPGVEFSSDTVWKYEREKAKDLSKALKEYDNLVFEAHSTDYQSPKSLREMVLDGFNILKVGPALTFGFREAAFALNKIEEEMFRFRPDIEESRFIQTLDYNMVKHPENWIKHYSGTSENIRFSRMYSLSDRCRYYMPNEEVEYSFNKMINNLDKEEIPIALISQYMHNQYKKVRDGELKPKGLNLLKDFIGEYVDDYIFAVEDK

SEQ ID NO: 15 - protein, 431 aa, Litorilinea aerophila
MYPVLENILRAQQQGEALGIPSICSAHPFVLEATFRHALTTGRTVLIESTCNQVNQHGGYTGMTPGDFVAYVAALADRLHFPRERILLGGDHLGPNPWRDRPADQALNQARILVQEYVRAGYGKIHLDASMACGGDPADAPLDKAVAAERAAALAEAAEAAFQRMGSGTPPCYVIGTEVPPPGGAQGDDMPLAITAPREVAETIELTQAAFRRRGLEAAWERVIAVVVQPGVEFGDEQVHPYDRAAAAGLARAIEPYGRLVYEAHSTDYQTRQALRDLVADHFAILKVGPALTFAFREAVFALAAVEEEWLAGQAGVVLSRLREELEAAMIQDPTHWRGYYRGDERHQRLARRYSYSDRARYYWPRPSVQAALERLLHNLEAAPPPLTLLSQYLPVQYWSVREGLLEPTPRSLIVDKIIQVLNDYTWACGG

SEQ ID NO: 16 - protein, 435 aa, Enterobacter mori.
MERKVKHLTHMVEQHKRGNANGIYAVCSAHPLVLEAAIRYAQSHQTPLLIEATSNQVDQFGGYTGMTPEDFYGFVCCLAESLDFPTSQLILGGDHLGPNRWQNLPAQQAMANADDLIKSYVAAGFKKIHLDCSMSCEDDPVPLTDAIVAERAARLAKIAEATCREQFGVTDLVYVIGTEVPVPGGAHETLTELEVTTPDAARATLEAHRHALEKEGLNDIWPRIIGLVVQPGVEFDHAHVCDYQPHKAVALSKMVEAYDTLLFEAHSTDYQTPQALRQLVKDHFAILKVGPALTFALREALFSLAAIEEELLPAKASSGLRHVLENVMLDRPEYWQSHYHGDGNARRLARGYSYSDRVRYYWPDSQIDDAFERLVRNLADEPIPLPLISQYLPLQYGKVREGALKSTPRELIIDHIQDILQQYHAACEGVTTQNA

SEQ ID NO: 17 - protein, 415 aa, Caldisericum exile
MWLDSNFLKNRGIFSICSSNENVLDASIEFAKEKEDFLLIEATCHQVNQFGGYTKMTPESFSKKIFKKAEEMNFNPERLLLGGDHLGPEPWKNENADTAMDKAKQLVIEFVKNGFNKIHLDCSMPLKGDSDFSTTLVADREAELCAVAEETYEKYGGNRPVYVVGTEVPAPGGSTNEVPEVTSIEELDEMIEELQNAFLRLGLKNAWDRVIAIVVRLGIGFGGDSVSEYESEKTKELCTYLSRYYPSLYFEAHSTDYQTAGSLKQMVKDGIRILKVGPALTDAYRRGMFALNFIEKESIDEEKQSRLVENVLKVMDEYPRYWEDYYNSVGKTLRLDQMYSYFDRIRYYWGFEEVEKSKNRLIENLKDMQMNLIRQYLPEQYEKIRENKLNKDPRALINYEIKKVLNDYQKSVILE

SEQ ID NO: 18 - protein, 408 aa, Dictyoglomus thermophilum
MWLSKDYLRKKGVYSICSSNPYVIEASVEFAKEKNDYILIEATPHQINQFGGYSGMTPEDFKNFVMGIIKEKGIEEDRVILGGDHLGPLPWQDEPSSSAMKKAKDLIRAFVESGYKKIHLDCSMSLSDDPVVLSPEKIAERERELLEVAEETARKYNFQPVYVVGTDVPVAGGGEEEGITSVEDFRVAISSLKKYFEDVPRIWDRIIGFVIMLGIGFNYEKVFEYDRIKVRKILEEVKKENLFVEGHSTDYQTKRALRDMVEDGVRILKVGPALTASFRRGVFLLSSIEDELISEDKRSNIKKVVLETMLKDDKYWRKYYKDSERLELDIWYNLLDRIRYYWEYKEIKIALNRLFENFSEGVDIRYIYQYFYDSYFKVREGKIRNDPRELIKNEIKKVLEDYHYAVNL

SEQ ID NO: 19 - protein, 420 aa, Rhodothermus marinus
MQAQALLTVPFDRVATHARGFVGWVAELLLGPLAHQHTLLAVCPNSEAVTRAALEAAAEVNAPLLFAATLNQVDLDGGYTGWTPATLARFVADELARLDLHIPVVLGLDHGGPWKKDLHARNRLSFAETVQAVLRAIEACLDAGYGLLHLDPTVDLELPPGTPVPIPRIVERTVALLRHAETYRLRRNLPPVAYEVGTEEVGGGLQAEARMAEFLDRLWTALDREGLPHPIFVVGDIGTRLDTRTFDFERACRLDALVRRYGALIKGHYTDDVDRLDLYPKAGIGGANVGPGLAAIEFEALEVLVDEARRRGLSVTFDQAIRRAVVESGRWTKWLQPEEKGRPFEALDPERQRWLVATGSRYVWTHPAVLQARRELYEALAPWLDADAFVRERIKARLMDYFRAFNLIHFNERLQAFLPE

SEQ ID NO: 20 - protein, 420 aa, Rhodothermus profundi
MQAHVLLAPSFEQLADHRHGFVGWLVDLLRGPLAYRHTLLAVCPNSEAVTRAALEAAREANAPLFFAATLNQVDLDGGYTGWTPATLARFVADERIRLGLRAPVVLGLDHGGPWKKDWHVRNRLPYEATLQAVLRAIEACLDAGYGLLHLDPTVDLELPPGTPVPIPRIVERTVALLQHAETYRQQRRLPPVAYEVGTEEVGGGLQAEARMAEFLDRLWTVLDREGLPRPVFVVGDIGTRLDTHTFDFERARRLDALVRRYGALIKGHYTDGVDRLDLYPQAGIGGANVGPGLAAIEFEALEALVAEAHRRKLPVTFDRTIRQAVIESGRWQKWLRPEEKGRPFEALPPERQRWLVATGSRYVWTHPAVRQARHQLYQVLAPWLDADAFVRARIKARLMDYFRAFNLIGFNERLQAFLPN

SEQ ID NO: 21 - protein, 428 aa, Caldibacillus debilis.
MAKIPIQSAVKALLELQDEGKGGTLLGIGPMSTNVLQASFELARDYDFPLMFIASRNQVDLDELGGGYVNGWNQYTFVQAIREMAELTGFDGLYYVCRDHGGPWQRDKERNDHLPVEEAMALGKKSYLADIEAGFDLLMIDPTKDPFEIGKVIPLEKVIERTVELIEFCEKERQARDLPEIGYEVGTEETNGGLTSTETYETFILRLQEELGRRDLPMPTFIVGQTGTLVRKTEQAGRFSFENAADLAKMAKKYGVGLKEHNGDYLDDVILLAHIPSQITATNVAPQYGTEETRALLKLAKLEEKLKEQGLIGQPSKVKDVLLYHSIKSERWRKWMVGSQRELSVEEIVKDEELSTEILDIAGHYTFNIDEVKEEINKLYRNLSKAHIDGQRFVVDHIKRSIRNYVECFNLKGLTSRIKEKLNGSKNA

SEQ ID NO: 22 - protein, 421 aa, Caloramator quimbayensis
MKKISIFEIVKASLNMKGKDKATLLGIGPMSKTLIKASMILAKEKDFPLMFIASRNQVDLKELGGGYVCNWDQKSFASDIKKIAEEVGFNGLYFLCRDHGGPWQRDNERNAHLPENEAMELGKKSYLEDLINGFDLLHIDPTKDPYIVGKTVPMEIVLKRTIELIEYVERERKERNLPPISYEVGTEETNGGLTSEEAYETFIKTLIEELDKRNLPKPSFIVGQTGTLTRLTENVGNFNTKNSKKLADIAKKYSVGLKEHNGDYLDEAILLEHPALGITAMNVAPEFGSVETQAYLKLIEVENNLYEHGIISKKSNLEKVIKEEAVKSLRWKKWMVGDKVNLSIEEVLSDKDLTDLITEISGHYTFNNERVKCEIQLMFDNLNKAGVDGEKYVINKIKDSIDKYIKYFNLEGFTTKVLSNV

SEQ ID NO: 23 - protein, 378 aa, Methanosalsum zhilinae
MTDTNYKAKPGSLLFESLMDKETIILAINPRISLLNKGILKAAKDMDAPIILELAKSECNLEGGYTGFTPSEFSKRAYESAEEIGIDIWSLHADHIGIKKGTDEEIESIKKLVKAQIDAGYTSFAIDASHLFNFRGGNLREELKDNIEATTKVARFIDEQMEDRDYGLEVEVGEIGREDEYGRVLTQPEEAVTFIKALNENGVYPQVLAIANGSAHGNTYDEYGHLIEQVSIDIPQTMAVARALRDNNLNVRIAQHGITGTPIEMIHNHFPHGDIIKGNVGTFYLNLVWDVLKVFEPQLYGDIWDWTIENFSEKYPDKSENEIFGKYSKYAIKEFFDRIYSVGDDTIRAVESRAYADTLVFLKAFKAAGMAEHVRKNL

SEQ ID NO: 24 - protein, 429 aa, Artificial Sequence
  mutant D-fructose C4-epimerase
MMFGSPAPLLDMVTAQKQGMARGIPSIASAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 25 - protein, 429 aa, Artificial Sequence
  mutant D-fructose C4-epimerase
MMFGSPAPLLDMVTAQKQGMARGIPSICSAHPVVLSAACHLARRSGAPLLIATTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 26 - protein, 429 aa, Artificial Sequence
  mutant D-fructose C4-epimerase
MMFGSPAPLLDMVTAQKQGMARGIPSICSAHPVVLSAACHLARRSGAPLLIQTTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 27 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGASGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 28 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGFSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 29 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGAHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 30 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGNHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 31 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDALGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 32 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIALDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 33 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLAASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 34 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLNASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 35 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSAVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 36 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSQVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 37 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYAAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 38 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYQAHSTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 39 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAASTDYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 40 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTAYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 41 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTNYQTRASLRALVEDHFSILKVGPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 42 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVAPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 43 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVDPALTFAYREAVFALEHIEREILGRQDMPLSRLSEVLDEVMLNDPRHWQGYFAGAPAEQALARRYSFSDRIRYYWHHPAAQEAVRRLLANLIETPPPLSLLSQYLPREYEMVRAGEISSHPQDLIRAHIQHTLEDYAAACG

SEQ ID NO: 44 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRAYWHHPAAQEAVRRLLANLIETPPPLSLLSQYLPREYEMVRAGEISSHPQDLIRAHIQHTLEDYAAACG

SEQ ID NO: 45 - protein, 429 aa, Artificial Sequence
  mutant D-fructose C4-epimerase
MMFGSPAPLLDMVTAQKQGMARGIPSICSAHPVVLSAACHLARRSGAPLLIETTCNQVNHQGGYSGMTPADFVRFLREILEREGIPPQQVILGGDHLGPYPWRKEPAETAIAQALEMVRAYVQAGYTKIHLDASMPCADDDPERPLPLERIARRAAQLCAAAEAAAGAVQPVYVIGSEVPPPGGAQGQEARLHVTTPQEAQAALDAFREAFLQAGLTPVWERVIALVVQPGVEFGVDSIHAYQREAARPLKTFIEGVPGMVYEAHSTDYQTRASLRALVEDHFSILKVGPALTFAYREAVFALEHIEREILGRQDMPLSRLSEVLDEVMLNDPRHWQGYFAGAPAEQALARRYSFSDRIRFYWHHPAAQEAVRRLLANLIETPPPLSLLSQYLPREYEMVRAGEISSHPQDLIRAHIQHTLEDYAAACG

SEQ ID NO: 46 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLPEDKIILGGDHLGPLPWQDEPAETAMNKAKDLIRAFVEAGYKKIHIDCSMPLSDDPKVLPYEKIAERTRELFEIAEETARKYNFQAVYVVGTDVPIAGGGEEEGVTSVEDFRSTLSVLKKAFKDLPNIWDRVVGFVIMLGIGFSYDKVFEYDRDKVREIMEEVKREDLFVEAHSTDYQDRYALRAMVEDGVRILKVGPALTAAFRRGVFLLSNIEDEIIPERERSNIKRVILETMLRDDRYWRKYYKDSKRLELDIWYSLLDRIRYYWEYEDVKMVLNKLFENFSEGVDIKFIYQYFYDQYFDVREGKMKNDPRELIKKEIKRVLEDYSYAINL

SEQ ID NO: 47 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSETAMNKAKDLIRAFVEAGYKKIHIDCSMPLSDDPKVLPLEKIAERTVELFKIAEETARKYNFQPVYVVGTDVPIAGGGEEEGVTSPEDFRSAISYLKKYFNDIPNIWDRVVGFVIMLGIGFSYDKVFEYDRDKVREILEEVKREDLFVEAHSTDYQARYALRNMVEDGVRILKVGPALTAAFRRAVFLLSNIEDEIIPERERSNIKRVILETMLRDDRYWRKYYKDSKRLEFDIWYNLLDRIRYYWEYEDVKMVLNKLFENFSEGVDIKFIYQYFYDSYFDVREGKMKNDPRELIKKEIKRVLEDYAYAINL

SEQ ID NO: 48 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKELGLEEDKIILGGDHLGPLPWQDEPAETAMNKAKDLIRAFVEAGYKKIHIDCSMPLSDDPKVLPYEKIAERTAELFEIAEEAARKYNFQAVYVVGTDVPIAGGGEEEGVTSVEDFRSMISTLKKYFNDVPNIWDRVVGFVIMLGIGFSYDKVFEYDRDKVRKILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKKVLNKLFENFSEGVDIKFIYQYFYDSYFDVREGKMKNDPRELIKKEIKRVLEDYSYAINL

SEQ ID NO: 49 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPAETAMNKAKDLIRAFVEAGYKKIHIDCSMPLSDDPKVLPYEKIAERTVELFEIAEETARKYNFQPVYVVGTDVPIAGGGEEEGVTSVEDFRSAISTLKKYFNDVPNIWDRVVGFVIMLGIGFSYDKVFEYDRDKVRDILEEVKREDLFVEGHSTDYQSRYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDQYFDVREGKLKNDPRELIKKEIKRVLEDYSYAINL

SEQ ID NO: 50 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLPEDKIILGGDHLGPLPWQDEPEETAMNKAKDLIRAFVEAGYKKIHIDCSMPLSDDPKVLPYEKIAERTRELFEIAEETARKYNFQPVYVVGTDVPIAGGGEEEGVTSVEDFRSALSILKKYFNDVPNIWDRVVGFVIMLGIGFSYDKVFEYDRDKVRELLEEVKREDLFVEGHSTDYQARYALRNMVEDGVRILKVGPALTAAFRRAVFLLSNIEDEIIPERERSNIKRVILETMLRDDRYWRKYYKDSKRLELDIWYNLLDRIRYYWEYEDVKKVLNKLFENFSEGVDIKFIYQYFYDSYFDVREGKMKNDPRELIKKEIKRVLEDYSYAINL

SEQ ID NO: 51 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLEEDKIILGGDHLGPLPWQDEPAPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVREILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKKALNKLFENFSEGVDIKFIYQYFYDSYFDVREGKMKNDPRELIKKEIKRVLEDYSYAINL

SEQ ID NO: 52 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPAETAMNKAKDLIRAFVESGYKKIHIDCSMPLSDDPKVLPYEKIAERTRELFEIAEETARKYNFQPVYVVGTDVPIAGGGEEEGVTSPEDFRSAISTLKKYFNDVPNIWDRVVGFVIMLGIGFSYDKVFEYDRDKVREILEEVKREDLFVEGHSTDYQARYALRNMVEDGVRILKVGPALTAAFRRGVFLLANIEDEIIPERERSNIKRVILETMLRDDRYWRKYYKDSKELELDIWYNLLDRIRYYWEYEDVKMVLNKLFENFSEGVDIKFIYQYFYDSYFDVREGKMKNDPRELIKKEIKRVLEDYSYAINL

SEQ ID NO: 53 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPAETAMNKAKDLIRAFVEAGYKKIHIDCSMPLSDDPKVLPYEKIAERTRELFEIAEETARKYNFQEVYVVGTDVPIAGGGEEEGVTSPEDFRSAISILKKYFNKVPNIWDRVVGFVIMLGIGFSYDKVFEYDRDKVRGILEEVKREDLFVEAHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 54 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLPEDKIILGGDHLGPLPWQDEPSETAMNKAKDLIRAFVESGYKKIHIDCSMPLSDDPKVLPYEKIAERTRELFEIAEETARKYNFQPVYVVGTDVPIAGGGEEEGVTSPEDFRSAISSLKKYFKDVPNIWDRVVGFVIMLGIGFSYDKVFEYDRDKVRGILEEVKREDLFVEAHSTDYQSRYALRNMVEDGVRILKVGPALTAAFRRAVFLLVNIEDEIIPERERSNIKRVILETMLRDDRYWRKYYKDSKRLELDIWYNLLDRIRYYWEYEDVKKVLNKLFENFSEGVDIKFIYQYFPDSYFDVREGKMKNDPRELIKKEIKRVLEDYYYAINL

SEQ ID NO: 55 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLPEDKIILGGDHLGPLPWQDEPSPTAMNKAKDLIRAFVEAGYKKIHIDCSMPLSDDPKVLPYEKIAERTRELCEIAEETARKYNFQPVYVVGTDVPIAGGGEEEGVTSVEDFRSAIDSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKMVLNKLFENFSEGVDIKFIYQYFPDSYFDVREGKMKNDPRELIKKEIKRVLEDYSYAINL

SEQ ID NO: 56 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFRIAEETARKYNFQPVYVVGTDVPIAGGGEEEGVTSPEDFRSAISLLKKYFNDVPNIWDRVVGFVIMLGIGFSYDKVFEYDRDKVRGILEEVKREDLFVEGHSTDYQARYALRNMVEDGVRILKVGPALTAAFRRAVFLLSNIEDEIIPERERSNIKRVILETMLRDDRYWRKYYKDSKRLELDIWYNLLDRIRYYWEYEDVKMVLNKLFENFSEGVDIKFIYQYFYDQYFDVREGKMKNDPRELIKKEIKRVLEDYSYAINL

SEQ ID NO: 57 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLEEDKIILGGDHLGPLPWQDEPSETAMNKAKDLIRAFVESGYKKIHIDCSMPLSDDPKVLPLEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYPDVKMVLNKLFENFSEGVDIKFIYQYFYDSYFDVREGKMKNDPRELIKKEIKRVLEDYSYAINL

SEQ ID NO: 58 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNAWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFPDSYFDVREGKMKNDPRELIKKEIKRVLEDYSYAINL

SEQ ID NO: 59 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLPEDKIILGGDHLGPLPWQDEPSETAMNKAKDLIRAFVESGYKKIHIDCSMPLSDDPKVLPPEKIAERTRELFEIAEETARKYNFQPVYVVGTDVPIAGGGEEEGVTSVEDFRSAISLLKKYFEDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 60 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVEAGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYSLLDRIRYYWEYEDVKMVLNKLFENFSEGVDIKFIYQYFYDSYFDVREGKMKNDPRELIKKEIKRVLEDYSYAINL

SEQ ID NO: 61 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTAELFEIAEETARKYNFQPVYVVGTDVPIAGGGEEEGVTSPEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHPDVKMVLNKLFENFSEGVDIKFIYQYFYDSYFDVREGKMKNDPRELIKKEIKRVLEDYSYAINL

SEQ ID NO: 62 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLEEDKIILGGDHLGPLPWQDEPAPTAMNKAKDLIRAFVESGYKKIHIDCSMPLSDDPKVLPYEKIAERTAELFEIAEETARKYNFQPVYVVGTDVPIAGGGEEEGVTSVEDFRSMISVLKKYFNDVPNIWDRVVAFVIMLGIGFSYDKVFEYDRDKVREILEEVKRTDLFVEGHSTDYQSRYALRNMVEDGVVILKVGPALTAAFRRGVFLLANIEDEIIPERERSNIKRVILETMLRDDRYWRKYYKDSKELELDLWYNLLDRIRYYWEYPDVKMVLNKLFENFSEGVDIKFIYQYFYDSYRDVREGKMKNDPRELIKKEIKRVLEDYSYAINL

SEQ ID NO: 63 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLEEDKIILGGDHLGPLPWQDEPAETAMEKAKDLIRAFVEAGYKKIHIDCSMPLSDDPKVLPYEKIAERTAELFEIAEETARKYNFQPVYVVGTDVPIAGGGEEEGVTSVEDFRSAISSLKKYFNDVPNIWDRVVGFVIMLGIGFSYDKVFEYDRDKVREILEEVKREDLFVEAHSTDYQARYALRNMVEDGVRILKVGPALTAAFRRAVFLLSNIEDEIIPPEERSNIKRVILETMLRDDRYWRKYYKDSKRLELDIWYNLLDRIRYYWEYEDVKMVLNKLFENLSDGVDIKFIYQYFYDSYFDVREGKLKNDPRELIKKEIKRVLEDYSYAINL

SEQ ID NO: 64 - protein, 408 aa, Artificial Sequence
  mutant D-fructose C4-epimerase
MWLSKDYLRKKGVYSICSSNSYVIEASIEFAKERGDYILIEATPHQVNQFGGYTGMTPEDFKNFVMKIAKEKGLEEDKIILGGDHLGPLPWQDEPAPTAMNKAKDLIRAFVEAGYKKIHIDCSMPLSDDPKVLPYEKIAERTRELFEIAEETARKYNFQPVYVVGTDVPIAGGGEEEGVTSVEDFRSTISSLKKYFKDVPNIWDRVVGFVIMLGIGFSYDKVFEYDRDKVRGILEEVKREDLFVEAHSTDYQARYALRNMVEDGVRILKVGPALTAAFRRGVFLLSDIEDEIIPERERSNIKRVILETMLRDDRYWRKYYKDSKRLELDIWYNLLDRIRYYWEYEDVKMALNKLFENFSEGVDIKFIYQYFYDSYFDVREGKMKNDPRELIKKEIKRVLEDYSYAINL

SEQ ID NO: 65 - protein, 408 aa, Artificial Sequence
  mutant D-fructose C4-epimerase
MWLSKDYLRKKGVYSICSSNPYVIEASIEFAKEKGDYILIEATPHQVNQFGGYTGMTPEDFKNFVMKIAKEKGLEEDKIILGGDHLGPLPWQDEPAPTAMNKAKDLIRAFVEAGYKKIHIDCSMPLSDDPKVLPYEKIAERTAELFEIAEETARKYNFQPVYVVGTDVPIAGGGEEEGVTSVEDFRSAISILKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKRVLNKLFENFSEGVDIKFIYQYFYDSYFDVREGKMKNDPRELIKKEIKRVLEDYSYAINL

SEQ ID NO: 66 - protein, 408 aa, Artificial Sequence
  mutant D-fructose C4-epimerase
MWLSKDYLRKKGVYSICSSNSYVIEASIEFAKERGDYILIEATPHQVNQFGGYSGMTPEDFKNFVMKIAKEKGLEEDKIILGGDHLGPLPWQDEPSETAMNKAKDLIRAFVEAGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVREILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 67 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLPEDKIILGGDHLGPLPWQDEPAETAMNKAKDLIRAFVEAGYKKIHIDCSMPCADDPKVLPYEKIAERTVELFEIAEETARKYNFQPVYVVGTDVPIAGGGEEEGVTSPEDFRSTISTLKKYFKDHPNIWDRVVAFVIMLGIGFSYDKVFEYDRDKVREILEEVKREDLFVECHSTDYQSRYALRNMVEDGVVILKVGPALTAAFRRAVFLLSDIEDEIIPERERSNIKRVILETMLRDDRYWRKYYKDSKRLELDIWYNLLDRIRYYWEYPDVKMALNKLFENFSDGIDIKFIYQYFYDSYRDVREGKMKNDPRELIKKEIKRVLEDYSYAINL

SEQ ID NO: 68 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLPEDKIILGGDHLGPLPWQDEPAPTAMNKAKDLIRAFVEAGYKKIHIDCSMPLSDDPKVLPYEKIAIRTRELFRIAEETARKYNFQPVYVVGTDVPIAGGGEEEGVTSVEDFRSMISTLKKYFNDVPNIWDRVVGFVIMLGIGFSYDKVFEYDRDKVRGILEEVKREDLFVEGHSTDYQARYALRWMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSDGVDIKFIYQYFYDAYFDVREGKMKPDPRELIKKEIKRVLEDYSYAINL

SEQ ID NO: 69 - protein, 408 aa, Artificial Sequence
  mutant D-fructose C4-epimerase
MWLSKDYLRKKGVYSICSSNPYVIEASIEFAKEKGDYILIEATPHQVNQFGGYTGMTPEDFKNFVMKIAKEKGLEEDKIILGGDHLGPLPWQDEPAETAMNKAKDLIRAFVESGYKKIHIDCSMPLSDDPKVLPYEKIAERTRELFEIAEETARKYNFQPVYVVGTDVPIAGGGEEEGVTSPEDFRSAISSLKKYFNDVPNIWDRVVAFVIMLGIGFSYDKVFEYDRDKVRGILEEVKRTDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDCYFDVREGKMKNDPRELIKKEIKRVLEDYSYAINL

SEQ ID NO: 70 - protein, 408 aa, Artificial Sequence
  mutant D-fructose C4-epimerase
MWLSKDYLRKKGVYSICSSNPYVIEAAIEFAKEKGDYILIEATPHQVNQFGGYTGMTPEDFKNFVMKIAKEKGLEEDRIILGGDHLGPLPWQDEPSDEAMEKAKDLIRAFVEAGYKKIHIDCSMPCADDPKVLPYEKIAERTRELFRIAEETARKYNFQPVYVVGTDVPIAGGGEEEGVTSPEDFRSTISTLKKYFEDHPNMWDRVVGFVIMLGVGFSHDKVFEYDRDKVRDILEEVKRTDLFVEGHSTDYQARYALRNMVEDGVRILKVGPWLTAAFRRAVFLLSNIEDEIIPERERSNIKRVILETMLRDDRYWRKYYKDSKRLELDIWYNLLDRIRYYWEHPDVKMALNKLFENFSEGVPIKFIYQYFYDCYFDVREGKMKNDPRELIKKEIKRVLEDYSYAINL

SEQ ID NO: 71 - protein, 408 aa, Artificial Sequence
  mutant D-fructose C4-epimerase
MWLSKDYLRKKGVYSICSSNSYVIEAAIEFAKEDGDPILIEATPHQVNQFGGYTGMTPEDFKNFVMKIAKEKGLPEDKIILGGDHLGPLPWQDEPSPTAMNKAKDLIRAFVEAGYKKIHIDCSMPCADDPKVLPYEKIAERTRELCEIAEETARKYNFQPVYVVGTDVPIAGGGEEEGVTSVEDFRSAISSLKKYFNDVPNIWDRVVGFVIMLGIGFSHDKVFEYDRDKVRGILEEVKREDLFVEGHSTDYQARYALRWMVEDGVVILKVGPALTAAFRRGVFLLSNIEDEIIPERERSNIKRVILETMLRDDRYWRKYYKDSKRLELDIWYSLLDRIRYYWEYPDVKMALNKLFENFSEGVPIKFIYQYFYDSYFDVREGKMKNDPRELIKKEIKRVLEDYSYAINL

SEQ ID NO: 72 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLEEDKIILGGDHLGPLPWQDEPSPTAMNKAKDLIRAFVEAGYKKIHIDCSMPLADDPKVLPYEKIAERTRELFEIAERTARKYNFQPVYVVGTDVPIAGGGEEEGVTSVEDFRSTISSLKKYFNDVPNIWDRVVGFVIMLGIGFSYDKVFEYDRDKVRDILEEVKRTDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKMALNKLFENLSEGVDIKLIYQYFYDSYFDVREGKMKNDPRELIKKEIKRVLEDYSYAINL

SEQ ID NO: 73 - protein, 408 aa, Artificial Sequence
  mutant D-fructose C4-epimerase
MWLSKDYLRKKGVYSICSSNPYVIEASIEFAKEKGDPILIEATPHQVNQFGGYSGMTPEDFKNFVMKIAKEKGLEEDKIILGGDHLGPLPWQDEPSPEAMNKAKDLIRAFVESGYKKIHIDCSMPLSDDPKVLPYEKIAERTRELCEIAEETARKYNFQPVYVVGTDVPIAGGGEEEGVTSVEDFRSTISSLKKYFNDVPNIWDRVVGFVIMLGIGFSHDKVFEYDRDKVRGILEEVKREDLFVEGHSTDYQARYALRWMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVPIKFIYQYFYDSYFDVREGKMKNDPRELIKKEIKRVLEDYSYAINL

SEQ ID NO: 74 - protein, 408 aa, Artificial Sequence
  mutant D-fructose C4-epimerase
MWLSKDYLRKKGVYSICSSNSWVIEASIEFAKEKGDYILIEATPHQVNQFGGYTGMTPEDFKNFVMKIAKEKGLEEDKIILGGDHLGPLPWQDEPSPTAMNKAKDLIRAFVESGYKKIHIDCSMPCSDDPKVLPYEKIAERTRELFEIAERTARKYNFQPVYVVGTDVPIAGGGEEEGVTSPEDFRSTISSLKKYFNDVPNIWDRVVGFVIMLGIGFSHDKVFEYDRDKVREILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYPDVKMALNKLFENLSEGVDIKFIYQYFYDSYFDVREGKMKNDPRELIKKEIKRVLEDYSYAINL

SEQ ID NO: 75 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSETAMEKAKDLIRAFVEAGYKKIHIDCSMPLADDPKVLPYEKIAERTRELFEIAEETARKYNFQPVYVVGTDVPIAGGGEEEGVTSVEDFRSAISSLKKYFNDHPNIWDRVVGFVIMLGIGFSHDKVFEYDRDKVRGILEEVKRTDLFVEGHSTDYQARYALRWMVEDGVRILKVGPALTAAFRRGVFLLSNIEDEIIPERERSNIKRVILETMLRDDRYWRKYYKDSKRLELDIWYNLLDRIRYYWEHEDVKMVLNKLFENFSEGVDIKFIYQYFYDSYFDVREGKMKNDPRELIKKEIKRVLEDYSYAINL

SEQ ID NO: 76 - protein, 408 aa, Artificial Sequence
  mutant D-fructose C4-epimerase
MWLSKDYLRKKGVYSICSSNSYVIEAAIEFAKEKGDYILIEATPHQVNQFGGYTGMTPEDFKNFVMKIAKEKGLPEDKIILGGDHLGPLPWQDEPSPEAMEKAKDLIRAFVEAGYKKIHIDCSMPLSDDPKVLPYEKIAERTRELFEIAEETARKYNFQPVYVVGTDVPIAGGGEEEGVTSVEDFRSTISSLKKYFNDVPNIWDRVVGFVIMLGIGFSYDKVFEYDRDKVRGILEEVKRTDLFVEGHSTDYQARYALRNMVEDGVRILKVGPALTAAFRRGVFLLSNIEDEIIPERGRSNIKRVILETMLRDDRYWRKYYKDSKRLELDIWYNLLDRIRYYWEYEDVKMALNKLFENFSEGVDIKFIYQYFYDSYFDVREGKMKNDPRELIKKEIKRVLEDYSYAINL

SEQ ID NO: 77 - protein, 408 aa, Artificial Sequence
  mutant D-fructose C4-epimerase
MWLSKDYLRKKGVFSICSSNSYVIEASIEFAKEKGDYILIEATPHQVNQFGGYSGMTPEDFKNFVMKIAKEKGLEEDKIILGGDHLGPLPWQDEPSETAMNKAKDLIRAYVESGFKKIHIDCSMPLSDDPKVLPMEKIAERTAELFKIAEETARKYNFQPVYVVGTDVPIAGGGEEEGVTSVEDFRSAISYLKKYFNDVPNIWDRVVGFVIMLGIGFSYDKVFEYDRDKVRGILEEVKREDLFVEAHSTDYQARYALRNMVEDGVRILKVGPALTAAFRRAVFLLSNIEDEIIPERERSNIKRVILETMLRDDRYWRKYYKDSKRLEFDIWYNLLDRIRYYWEYEDVKKVLNKLFENFSEGVDIKFIYQYFYDSYFDVREGKMKNDPRELIKKEIKRVLEDYAYAINL

SEQ ID NO: 78 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSETAMNKAKDLIRAFVEAGYKKIHIDCSMPLSDDPKVLPYEKIAERTRELFEIAEETARKYNFQPVYVVGTDVPIAGGGEEEGVTSPEDFRSFISSLKKYFNDVPNIWDRVVGFVIMLGIGFSYDKVFEYDRDKVREILEELKREDLFVEGHSTDYQSRYALRNMVEDGVRILKVGPALTAAFRRGVFLLSNIEDEIIPERERSNIKRVILETMLRDDRYWRKYYKDSKRLELDIWYNLLDRIRYYWEYEDVKTVLNKLFENFSEGVDIKFIYQYFYDSYFDVREGKLKNDPRELIKKEIKRVLEDYSYAINL

SEQ ID NO: 79 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPAETAMNKAKDLIRAFVEAGYKKIHIDCSMPLSDDPKVLPYEKIAERTRELFKIAEETARKYNFQAVYVVGTDVPIAGGGEEEGVTSAEDFRSAISILKKYFNDVPNIWDRVVGFVIMLGIGFSYDKVFEYDRDKVRDILEEVKREDLFVEAHSTDYQARYALRNMVEDGVRILKVGPALTAAFRRGVFLLANIEDEIIPERERSNIKRVILETMLRDDRYWRKYYKDSKELELDIWYNLLDRIRYYWEYEDVKKVLNKLFENFSEGVDIKFIYQYFYDSYFDVREGKMKNDPRELIKKEIKRVLEDYSYAINL

SEQ ID NO: 80 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLPEDKIILGGDHLGPLPWQDEPSPTAMNKAKDLIRAFVESGYKKIHIDCSMPLSDDPKVLPYEKIAERTAELFEVAEETARKYNFQPVYVVGTDVPIAGGGEEEGVTSVEDFRSAISILKKYFNDVPNIWDRVVGFVIMLGIGFSYDKVFEYDRDKVRGILEEVKREDLFLEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYPDVKMVLNKLFENFSEGVDIKFIYQYFYDSYFDVREGKMKNDPRELIKKEIKRVLEDYSYAINL

SEQ ID NO: 81 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKELGLEEDKIILGGDHLGPLPWQDEPSETAMNKAKDLIRAFVESGYKKIHIDCSMPLSDDPKVLPYEKIAERTRELFEIAEETARKYNFQPVYVVGTDVPIAGGGEEEGVTSVEDFRSMISTLKKYFNKVPNIWDRVVGFVIMLGIGFSYDKVFEYDRDKVREILEEVKREDLFVEGHSTDYQARYALRNMVEDGVRILKVGPALTAAFRRGVFLLSNIEDEIIPERERSNIKRVILETMLRDDRYWRKYYKDSKELELDIWYNLLDRIRYYWEYEDVKMVLNKLFENFSEGVDIKFIYQYFYDSYFDVREGKMKNDPRELIKKEIKRVLEDYAYAINL

SEQ ID NO: 82 - protein, 408 aa, Artificial Sequence
  mutant D-fructose C4-epimerase
MWLSKDYLRKKGVYSICSNNSYVIEASIEFAKEKGDYILIEATPHQVNQFGGYSGMTPEDFKNFVMKIAKEVGLEEDKIILGGDHLGPLPWQDEPAETAMNKAKDLIRAFVESGYKKIHIDCSMPLSDDPKVLPYEKIAERTRELFEIAEETARKYNFQPVYVVGTDVPIAGGGEEEGVTSVEDFRSAIDTLKKYFKDVPNIWDRVVGFVIMLGIGFSYDKVFEYDRDKVREILEEVKREDLFVEAHSTDYQARYALRNMVEDGVRILKVGPALTAAFRRAVFLLSNIEDEIIPERERSNIKRVILETMLRDDRYWRKYYKDSKRLELDIWYNLLDRIRYYWEYEDVKMVLNKLFENFSEGVDIKFIYQYFPDSYFDVREGKMKNDPRELIKKEIKRVLEDYYYAINL

SEQ ID NO: 83 - protein, 408 aa, Artificial Sequence
  mutant D-fructose C4-epimerase
MWLSKDYLRKKGVYSICSSNKYVIEASIEFAKEKGDYILIEATPHQVNQFGGYSGMTPEDFKNFVMKIAKEKGLPEDKIILGGDHLGPLPWQDEPSETAMNKAKDLIRAFVEAGYKKIHIDCSMPLSDDPKVLPYEKIAERTVELFEIAEETARKYNFQPVYVVGTDVPIAGGGEEEGVTSVEDFRSAISTLKKYFNDIPNIWDRVVAFVIMLGIGFSYDKVFEYDRDKVREILEEVKREDLFLEAHSTDYQARYALRAMVEDGVRILKVGPALTAAFRRAVFLLANIEDEIIPERERSNIKRVILETMLRDDRYWRKYYKDSKRLELDIWYNLLDRIRYYWEYPDVKMVLNKLFENFSEGVDIKFIYQYFPDQYFDVREGKMKNDPRELIKKEIKRVLEDYSYAINL

SEQ ID NO: 84 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLPEDKIILGGDHLGPLPWQDEPSPTAMNKAKDLIRAFVESGYKKIHIDCSMPLSDDPKVLPLEKIAERTRELFRIAEETARKYNFQPVYVVGTDVPIAGGGEEEGVTSPEDFRSAIETLKKYFNDVPNIWDRVVGFVIMLGIGFSYDKVFEYDRDKVRGILEEVKRTDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKKVLNKLFENFSEGVDIKFIYQYFYDQYFDVREGKMKNDPRELIKKEIKRVLEDYSYAINL

SEQ ID NO: 85 - protein, 408 aa, Artificial Sequence
  mutant D-fructose C4-epimerase
MWLSKDYLRKKGVYSICSSNPYVIEAAIEFAKEKGDYILIEATPHQVNQFGGYSGMTPEDFKNFVMKIAKEKGLEEDKIILGGDHLGPLPWQDEPSETAMNKAKDLIRAFVEAGYKKIHIDCSMPLSDDPKVLPTEKIAERTRELFEIAEETARKYNFQPVYVVGTDVPIAGGGEEEGVTSVEDFRSAISSFKKYFNDVPNIWDRVVGFVIMLGIGFSDDKVFEYDRDKVRGILEEVKREDLFVEGHSTDYQARYALRNMVEDGVRILKVGPALTAAFRRAVFLLANIEDEIIPERERSNIKRVILETMLRDDRYWRKYYKDSKRLELDIWYNLLDRIRYYWEHPDVKMVLNKLFENFSEGVDIKFIYQYFYDSYEDVREGKMKNDPRELIKKEIKRVLEDYSYAINL

SEQ ID NO: 86 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLPEDKIILGGDHLGPLPWQDEPAPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRDILEEVKREDLFVEGHSTDYQARYALRNMVEDGVRILKVGPALTAAFRRGVFLLANIEDEIIPERERSNIKRVILETMLRDDRYWRKYYKDSKRLELDIWYNLLDRIRYYWEYPDVKMVLNKLFENFSEGVDIKFIYQYFPDSYFDVREGKMKNDPRELIKKEIKRVLEDYSYAINL

SEQ ID NO: 87 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLEEDKIILGGDHLGPLPWQDEPSPTAMEKAKDLIRAFVEAGYKKIHIDCSMPLSDDPKVLPPEKIAERTRELFEIAEETARKYNFQPVYVVGTDVPIAGGGEEEGVTSVEDFREAIESLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKMVLNKLFENFSEGVDIKFIYQYFYDSYFDVREGKMKNDPRELIKKEIKRVLEDYSYAINL

SEQ ID NO: 88 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPAPTAMNKAKDLIRAFVESGYKKIHIDCSMPLSDDPKVLPLEKIAERTRELFEIAERTARKYNFQPVYVVGTDVPIAGGGEEEGVTSPEDFRSAIDSLKKYFNDVPNIWDRVVGFVIMLGIGFSYDKVFEYDRDKVRDILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIRFIYQYFYDSYFDVREGKMKNDPRELIKKEIKRVLEDYSYAINL

SEQ ID NO: 89 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLPEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRRAISSLKKYFNDVPNIWDRVVGFVIMLGIGFSYDKVFEYDRDKVRGILEEVKREDLFVEGHSTDYQARYALRNMVEDGVRILKVGPALTAAFRRAVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 90 - protein, 408 aa, Artificial Sequence
  mutant D-fructose C4-epimerase
MWLSKDYLRKKGVYSICSSNSYVIEAAIEFAKEKGDYILIEATPHQVNQFGGYTGMTPEDFKNFVMKIAKEKGLEEDKIILGGDHLGPLPWQDEPAPTAMNKAKDLIRAFVESGYKKIHIDCSMPLSDDPKVLPYEKIAERTRELCEIAEETARKYNFQPVYVVGTDVPIAGGGEEEGVTSPEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKMALNKLFENFSEGVDIKFIYQYFYDSYFDVREGKMKNDPRELIKKEIKRVLEDYAYAINL

SEQ ID NO: 91 - protein, 408 aa, Artificial Sequence
  mutant D-fructose C4-epimerase
MWLSKDYLRKKGVYSICSSNPWVIEASIEFAKEKGDYILIEATPHQVNQFGGYTGMTPEDFKNFVMKIAKEKGLPEDKIILGGDHLGPLPWQDEPSPTAMNKAKDLIRAFVEAGYKKIHIDCSMPLSDDPKVLPYEKIAERTRELFEIAEETARKYNFQPVYVVGTDVPIAGGGEEEGVTSPEDFRSAISSLKKYFEDVPNIWDRVVGFVIMLGIGFSYDKVFEYDRDKVRGILEEVKRTDLFVEVHSTDYQARYALRNMVEDGVRILKVGPALTAAFRRGVFLLANIEDEIIPERERSNIKRVILETMLRDDRYWRKYYKDSKELELDLWYNLLDRIRYYWEHPDVKMVLNKLFENFSEGVDIKFIYQYFYDSYRDVREGKMKNDPRELIKKEIKRVLEDYSYAINL

SEQ ID NO: 92 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLPEDKIILGGDHLGPLPWQDEPAPTAMEKAKDLIRAFVESGYKKIHIDCSMPLADDPKVLPYEKIAERTRELFEIAEETARKYNFQPVYVVGTDVPIAGGGEEEGVTSVEDFRSTISTLKKYFEDHPRIWDRVVAFVIMLGIGFSYDKVFEYDRDKVREILEEVKRTDLFVECHSTDYQARYALRNMVEDGVRILKVGPALTAAFRRGVFLLADIEDEIIPEEERSNIKRVILETMLRDDRYWRKYYKDSKRLELDIWYALLDRIRYYWEYEDVKRVLNKLFENFSEGVDIKFIYQYFYDCYFDVREGKMKNDPRELIKKEIKRVLEDYSYAINL

SEQ ID NO: 93 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLEEDKIILGGDHLGPLPWQDEPSPTAMNKAKDLIRAFVEAGYKKIHIDCSMPLSDDPKVLPYEKIAIRTAELFEIAEETARKYNFQPVYVVGTDVPIAGGGEEEGVTSPEDFRSMISTLKKYFNDVPNIWDRVVGFVIMLGIGFSYDKVFEYDRDKVREILEEVKREDWFVEAHSTDYQPRYALRWMVEDGVRILKVGPALTAAFRRAVFLLSNIEDEIIPERERSNIKRVILETMLRDDRYWRKYYKDSKELELDIWYALLDRIRYYWEYEDVKMALNKLFENFSDGVDIKFIYQYFYDSYFDVCEGKMKPDPRELIKKEIKRVLEDYSYAINL

SEQ ID NO: 94 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLPEDKIILGGDHLGPLPWQDEPAETAMNKAKDLIRAFVESGYKKIHIDCSMPLADDPKVLPYEKIAERTVELFEIAEETARKYNFQPVYVVGTDVPIAGGGEEEGVTSPEDFRSAISTLKKYFNDCPNIWDRVVGFVIMLGIGFSYDKVFEYDRDKVRGILEELKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKAVLNKLFENLSEGVDIKFIYQYFYDSYFDVREGKMKNDPRELIKKEIKRVLEDYSYAINL

SEQ ID NO: 95 - protein, 408 aa, Artificial Sequence
  mutant D-fructose C4-epimerase
MWLSKDYLRKKGVYSICSSNPYVIEAAIEFAKEKGDYILIEATPHQVNQFGGYSGMTPEDFKNFVMKIAKEKGLEEDKIILGGDHLGPLPWQDEPSETAMNKAKDLIRAFVEAGYKKIHIDCSMPLADDPKVLPYEKIAERTRELFEIAEEAARKYNFQPVYVVGTDVPIAGGGEEEGVTSVEDFRSMISVLKKYFNDVPNIWDRVVGFVIMLGIGFSYDKVFEYDRDKVREILEEVKREDLFVEGHSTDYQARYALRNMVEDGVVILKVGPWLTAAFRRGVFLLADIEDEIIPERERSNIKRVILETMLRDDRYWRKYYKDSKRLELDIWYALLDRIRYYWEYPDVKKVLNKLFENFSEGIDIKFIYQYFYDSYFDVREGKMKNDPRELIKKEIKRVLEDYSYAINL

SEQ ID NO: 96 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLPEDKIILGGDHLGPLPWQDEPAETAMNKAKDLIRAFVESGYKKIHIDCSMPLSDDPKVLPYEKIAERTRELFEIAEETARKYNFQPVYVVGTDVPIAGGGEEEGVTSVEDFRSTISSLKKYFNDVPNIWDRVVGFVIMMGIGFSYDKVFEYDRDKVREILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKMVLNKLFENFSEGVDIKFIYQYFYDCYFDVREGKMKNDPRELIKKEIKRVLEDYSYAINL

SEQ ID NO: 97 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLEEDKIILGGDHLGPLPWQDEPSETAMNKAKDLIRAFVESGYKKIHIDCSMPLADDPKVLPYEKIAERTAELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYPDVKKALNKLFENFSEGVDIKFIYQYFYDSYFDVREGKMKNDPRELIKKEIKRVLEDYSYAINL

SEQ ID NO: 98 - protein, 408 aa, Artificial Sequence
  mutant D-fructose C4-epimerase
MWLSKDYLRKKGVYSICSSNSWVIEASIEFAKEDGDPILIEATPHQVNQFGGYTGMTPEDFKNFVMKIAKEKGLPEDKIILGGDHLGPLPWQDEPSPTAMNKAKDLIRAFVEAGYKKIHIDCSMPLSDDPKVLPYEKIAERTRELCEIAEETARKYNFQPVYVVGTDVPIAGGGEEEGVTSVEDFRSTISSLKKYFNDVPNIWDRVVGFVIMLGIGFSYDKVFEYDRDKVRDILEEVKREDLFVEGHSTDYQARYALRNMVEDGVAILKVGPALTAAFRRGVFLLANIEDEIIPEEERSNIKRVILETMLRDDRYWRKYYKDSKRLELDIWYNLLDRIRYYWEHPDVKMVLNKLFENFSEGVDIKFIYQYFYDSYFDVREGKMKNDPRELIKHEIKRVLEDYSYAINL

SEQ ID NO: 99 - protein, 408 aa, Artificial Sequence
  mutant D-fructose C4-epimerase
MWLSKDYLRKKGVYSICSSNPWVIEAAIEFAKEKGTYILIEATPHQVNQFGGYTGMTPEDFKNFVMKIAKEKGLPEDKIILGGDHLGPLPWQDEPSEEAMNKAKDLIRAFVESGYKKIHIDCSMPLADDPKVLPYEKIAERTRELFRIAEETARKYNFQPVYVVGTDVPIAGGGEEEGVTSVEDFRSAISLLKKYFEDHPNIWDRVVGFVIMLGIGFSYDKVFEYDRDKVREILEEVKREPLFVEGHSTDYQAREALRNMVEDGVRILKVGPALTAAFRRGVFLLSDIEDEIIPERERSNIKRVILETMLRDDRYWRKYYKDSKRLELDIWYNLLDRIRYYWEHEDVKMALNKLFENFSEGVDITFIYQYFYDCYFDVREGKMKNDPRELIKKEIKRVLEDYSYAINL

SEQ ID NO: 100 - protein, 408 aa, Artificial Sequence
  mutant D-fructose C4-epimerase
MWLSKDYLRKKGVYSICSSNPYVIEAAIEFAKEKGDYILIEATPHQVNQFGGYSGMTPEDFKNFVMKIAKEKGLPEDKIILGGDHLGPLPWQDEPSETAMEKAKDLIRAFVEAGYKKIHIDCSMPLSDDPKVLPYEKIAERTRELFKIAEETARKYNFQPVYVVGTDVPIAGGGEEEGVTSPEDFRSTIESLKKYFNDVPNIWDRVVGFVIMLGIGFSHDKVFEYDRDKVRGILEEVKREDLFVEGHSTDYQARDALRNMVEDGVRILKVGPALTAAFRRAVFLLSNIEDEIIPERERSNIKRVILETMLRDDRYWRKYYKDSKRLELDIWYNLLDRIRYYWNHEDVKMALNKLFENFSDGVDIKFIYQYFYDSYFDVREGKMKNDPRELIKHEIKRVLEDYSYAINL

SEQ ID NO: 101 - protein, 408 aa, Artificial Sequence
  mutant D-fructose C4-epimerase
MWLSKDYLRKKGVYSICSSNSWVIEASIEFAKEKGSYILIEATPHQVNQFGGYSGMTPEDFKNFVMKIAKEKGLPEDKIILGGDHLGPLPWQDEPSDTAMEKAKDLIRAFVEAGYKKIHIDCSMPCADDPKVLPYEKIAERTRELFEIAEETARKYNFQPVYVVGTDVPIAGGGEEEGVTSPEDFRSAISSLKKYFEDVPNIWDRVVGFVIMLGIGFSHDKVFEYDRDKVRGILEEVKREPLFVEGHSTDYQSRDALRNMVEDGVRILKVGPALTAAFRRGVFLLANIEDEIIPEEERSNIKRVILETMLRDDRYWRKYYKDSKRLELDIWYNLLDRIRYYWNYPDVKMVLNKLFENFSEGVDITFIYQYFYDSYRDVREGKMKNDPRELIKKEIKRVLEDYSYAINL

SEQ ID NO: 102 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFRNFVMKIAKEKGLEEDKIILGGDHLGPLPWQDEPSETAMNKAKDLIRAFVEAGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVREILEEVKRTDLFVEGHSTDYQARYALRWMVEDGVRILKVGPALTAAFRRGVFLLANIEDEIIPERGRSNIKRVILETMLRDDRYWRKYYKDSKRLELDIWYNLLDRIRYYWEYEDVKMVLNKLFENFSEGVDIKFIYQYFYDSYHDVREGKMKNDPRELIKKEIKRVLEDYSYAINL

SEQ ID NO: 103 - protein, 408 aa, Artificial Sequence
  mutant D-fructose C4-epimerase
MWLSKDYLRKKGIYSICSSNPYVIEAAIEFAKEKGDYILIEATPHQVNQFGGYTGMTPEDFKNFVMKIAKEKGLPEDKIILGGDHLGPLPWQDEPSEEAMNKAKDLIRAFVESGYKKIHIDCSMPCSDDPKVLPYEKIAERTRELCRIAEETARKYNFQPVYVVGTDVPIAGGGEEEGVTSVEDFRSTIESLKKYFNDVPNAWDRVVGFVIMLGIGFSYDKVFEYDRDKVRGILEEVKREPLFVEGHSTDYQARYALRWMVEDGVRILKVGPALTAAFRRAVFLLSNIEDEIIPEEERSNIKEVILETMLRDDRYWRKYYKDSKRLELDIHYNLLDRIRYYWEYPDVKAALNKLFENFSDGVDIKFIYQYFYDAYHDVREGKMKNDPRELIKKEIKRVLEDYSYAINL

SEQ ID NO: 104 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLEEDKIILGGDHLGPLPWQDEPAPEAMEKAKDLIRAFVESGYKKIHIDCSMPCSDDPKVLPYEKIAERTRELFEIAEETARKYNFQPVYVVGTDVPIAGGGEEEGVTSVEDFRSAISSLKKYFNDVPNIWDRVVGFVIMLGIGFSHDKVFEYDRDKVRGILEEVKRTDLFVEGHSTDYQTRYALRNMVEDGVRILKVGPALTAAFRRGVFLLSNIEDEIIPEYERSNIKRVILETMLRDDRYWRKYYKDSKRLELDIWYNLLDRIRYYWEHPDVKAVLNKLFENFSEGVDIKLIYQYFYDSYFDVREGKMKNDPRELIKKEIKRVLEDYSYAINL

SEQ ID NO: 105 - protein, 408 aa, Artificial Sequence
  mutant D-fructose C4-epimerase
MWLSKDYLRKKGVYSICSSNSYVIEAAIEFAKEKDDYILIEATPHQVNQFGGYSGMTPEDFKNFVMKIAKELGLPEDKIILGGDHLGPLPWQDEPSETAMNKAKDLIRAYVEAGYKKIHIDCSMPLSDDPKVLPMEKIAERTRELFKIAEETARKYNFQPVYVVGTDVPIAGGGEEEGVTSVEDFRSAISLLKKYFKDVPNIWDRVVGFVIMLGIGFSYDKVFEYDRDKVREILEEVKREDLFVEGHSTDYQARYALRNMVEDGVRILKVGPALTAAFRRAVFKLSNIEDELIPERERSNIKRVILETMLRDDRYWRKYYKDSKRLEFDIWYNLLDRIRYYWEYEDVKKVLNKLFENFSEGVDIKFIYQYFPDSYKDVREGKMKNDPRELIKKEIKRVLEDYSYAINL

SEQ ID NO: 106 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSETAMNKAKDLIRAFVESGYKKIHIDCSMPLSDDPKVLPKEKIAERTVELFEIAEETARKYNFQPVYVVGTDVPIAGGGEEEGVTSVEDFRSAISSLKKYFNDVPNIWDRVVGFVIMLGIGFSYDKVFEYDRDKVRDILEELKREDLFVEGHSTDYQARYALRNMVEDGVRILKVGPALTAAFRRGVFLLANIEKEIIPERERSNIKRVILETMLRDDRYWRKYYKDSKRLELDIWYNLLDRIRYYWEHEDVKTVLNKLFENFSEGVDIKFIYQYFYDSYFDVREGKLKNDPRELIKKEIKRVLEDYSYAINL

SEQ ID NO: 107 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKELGLPEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISVFKKYFKDLPNIWDRVVGFVVMLGIGFSYDKVFEYDRDKVREILEEVKREDLFVEGHSTDYQARYALRNMVEDGVRILKVGPALTAAFRRGVFLLANIEDEIIPERERSNIKRVILETMLRDDRYWRKYYKDSKRLELDIWYNLLDRIRYYWEYEDVKMVLNKLFENFSEGVDIKFIYQYFYDQYFDVREGKMKNDPRELIKKEIKRVLEDYSYAINL

SEQ ID NO: 108 - protein, 408 aa, Artificial Sequence
  mutant D-fructose C4-epimerase
MWLSKDYLRKKGVYSICSSNPYVIEAAIEFAKEKGDYILIEATPHQVNQFGGYTGMTPEDFKNFVMKIAKEVGLEEDRIILGGDHLGPLPWQDEPSETAMNKAKDLIRAFVESGYKKIHIDCSMPLSDDPKVLPYEKIAERTRELFEIAEETARKYNFQPVYVVGTDVPIAGGGEEEGVTSVEDFRSAIDILKKYFNKVPNIWDRVVGFVIMLGIGFSYDKVFEYDRDKVRGILEEVKREDLFVEGHSTDYQARYALRNMVEDGVRILKVGPALTAAFRRGVFLLANIEDEIIPERERSNIKRVILETMLRDDRYWRKYYKDSKELELDIWYNLLDRIRYYWEYEDVKKVLNKLFENFSEGVDIKFIYQYFYDSYFDVREGKMKNDPRELIKKEIKRVLEDYSYAINL

SEQ ID NO: 109 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLEEDKIILGGDHLGPLPWQDEPSPTAMNKAKDLIRAFVEAGYKKIHIDCSMPLSDDPKVLPLEKIAERTRELFEIAEETARKYNFQPVYVVGTDVPIAGGGEEEGVTSVEDFRSMIDTLKKYFEDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKELELDIWYNLLDRIRYYWEYEDVKMVLNKLFENFSEGVDIKFIYQYFYDSYQDVREGKMKNDPRELIKKEIKRVLEDYSYAINL

SEQ ID NO: 110 - protein, 408 aa, Artificial Sequence
  mutant D-fructose C4-epimerase
MWLSKDYLRKKGVYSICSSNSYVIEAAIEFAKEKGDYILIEATPHQVNQFGGYSGMTPEDFKNFVMKIAKEKGLEEDKIILGGDHLGPLPWQDEPSPTAMEKAKDLIRAFVEAGYKKIHIDCSMPLSDDPKVLPLEKIAERTRELFKVAEETARKYNFQPVYVVGTDVPIAGGGEEEGVTSVEDFRSAISSFKKYFKDVPNIWDRVVGFVIMLGIGFSYDKVFEYDRDKVRGILEEVKRTDLFVEGHSTDYQDRKALRDMVEDGVRILKVGPALTAAFRRAVFLLANIEKEIIPERERSNIKRVILETMLRDDRYWRKYYKDSKRLELDIWYNLLDRIRYYWEYPDVKCVLNKLFENFSEGVDIRFIYQYFYDQYFDVREGKMKNDPRELIKKEIKRVLEDYSYAINL

SEQ ID NO: 111 - protein, 408 aa, Artificial Sequence
  mutant D-fructose C4-epimerase
MWLSKDYLRKKGVYSICSSNPYVIEAAIEFAKEKGDYILIEATPHQVNQFGGYTGMTPEDFKNFVMKIAKEKGLPEDKIILGGDHLGPLPWQDEPSETAMEKAKDLIRAFVESGYKKIHIDCSMPLSDDPKVLPLEKIAERTRELFEIAEETARKYNFQPVYVVGTDVPIAGGGEEEGVTSVEDFREAIEYLKKYFEDLPNIWDRVVGFVIMLGIGFSYDKVFEYDRDKVRDILEEVKREDLFVEGHSTDYQDRYALRNMVEDGVRILKVGPALTAAFRRGVFLLSNIEDEIIPEDERSNIKRVILETMLRDDRYWRKYYKDSKRLELDIWYNLLDRIRYYWEHPDVKMVLNKLFENFSEGVDIRFIYQYFYDSYFDVREGKMKNDPRELIKKEIKRVLEDYSYAINL

SEQ ID NO: 112 - protein, 408 aa, Artificial Sequence
  mutant D-fructose C4-epimerase
MWLSKDYLRKKGVYSICSSNEYVIEASIEFAKEKGDYILIEATPHQVNQFGGYTGMTPEDFKNFVMKIAKEKGLEEDKIILGGDHLGPLPWQDEPAPTAMNKAKELIRAFVEAGYKKIHIDCSMPLSDDPKVLPLEKIAERTRELFEIAEETARKYNFQPVYVVGTDVPIAGGGEEEGVTSPEDFRSAIEALKKYFNDVPNIWDRVVGFVIMLGIGFSYDKVFEYDRDKVRGILEEVKRTDLFVEGHSTDYQTRYALRNMVEDGVRILKVGPALTAAFRRGVFLLANIEDEIIPERERSNIKRVILETMLRDDRYWRKYYKDSKRLELDIWYNLLDRIRYYWEYEDVKMVLNKLFENFSEGVDIRFIYQYFYDSYFDVREGKMKNDPRELIKKEIKRVLEDYSYAINL

SEQ ID NO: 113 - protein, 408 aa, Artificial Sequence
  mutant D-fructose C4-epimerase
MWLSKDYLRKKGVYSICSSNEYVIEASIEFAKEKGDYILIEATPHQVNQFGGYTGMTPEDFKNFVMKIAKEKGLPEDKIILGGDHLGPLPWQDEPSPTAMEKAKDLIRAFVEAGYKKIHIDCSMPLSDDPKVLPMEKIAERTRELFKIAEETARKYNFQPVYVVGTDVPIAGGGEEEGVTSVEDFRSAIESLKKYFNDVPNIWDRVVGFVIMLGIGFSYDKVFEYDRDKVRPILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEHEDVKKVLNKLFENFSEGVDIRFIYQYFYDSYFDVREGKMKNDPRELIKKEIKRVLEDYAYAINL

SEQ ID NO: 114 - protein, 408 aa, Artificial Sequence
  mutant D-fructose C4-epimerase
MWLSKDYLRKKGVYSICSSNSYVIEASIEFAKEKGDYILIEATPHQVNQFGGYTGMTPEDFKNFVMKIAKEKGLPEDKIILGGDHLGPLPWQDEPSETAMEKAKDLIRAFVEAGYKKIHIDCSMPLSDDPKVLPTEKIAERTRELFEVAEETARKYNFQPVYVVGTDVPIAGGGEEEGVTSVEDFREAIESFKKYFNDVPNIWDRVVGFVIMLGIGFSDDKVFEYDRDKVRDIAEEVKREDLFVEGHSTDYQARYALRNMVEDGVRILKVGPALTAAFRRGVFLLANIEDEIIPERKRSNIKRVILETMLRDDRYWRKYYKDSKRLRLDIWYNLLDRIRYYWEYEDVKMALNRLFENFSEGVDIKFIYQYFYDSYFDVREGKMKNDPRELIKKEIKRVLEDYSYAINL

SEQ ID NO: 115 - protein, 408 aa, Artificial Sequence
  mutant D-fructose C4-epimerase
MWLSKDYLRKKGVYSICSSNSYVIEAAIEFAKEKGDYILIEATPHQVNQFGGYTGMTPEDFKNFVMKIAKEKGLPEDKIILGGDHLGPLPWQDEPSEEAMAKAKDLIRAFVEAGYKKIHIDCSMPLADDPKVLPYEKIAERTRELFEIAEETARKYNFQPVYVVGTDVPIAGGGEEEGVTSVEDFRSAISVLKKYFKDLPNIWDRVVGFVIMMGIGFSYDKVFEYDRDKVREILEEVKREDLFVEAHSTDYQARYALRWMVEDGVRILKVGPALTAAFRRGVFLLADIEDEIIPERERSNIKRVILETMLRDDRYWRKYYHDSKRLELDIWYSLLDRIRYYWEHPDVKAALNKLFENFSEGVDIKFIYQYFYDSYFDVREGKMKNDPRELIKKEIKRVLEDYSYAINL

SEQ ID NO: 116 - protein, 408 aa, Artificial Sequence
  mutant D-fructose C4-epimerase
MWLSKDYLRKKGVYSICSSNPYVIEACIEFAKEKGDYILIEATPHQVNQFGGYTGMTPEDFKNFVMKIAKEKGLPEDKIILGGDHLGPLPWQDEPSPEAMNKAKDLIRAFVEAGYKKIHIDCSMPLADDPKVLPYEKIAERTRELFEIAEETARKYNFQPVYVVGTDVPIAGGGEEEGVTSPEDFRSFISVLKKYFNDVPNIWDRVVGFVIMLGIGFSYDKVFEYDRDKVREILEEVKREDLFVEGHSTDYQSREALRNMVEDGVRILKVGPALTAAFRRGVFLLDNIEKDIIPERERSNIKRVILETMLRDDRYWRKYYKDSKRLELDIWYSLLDRIRYYWEHEDVKMALNKLFENLSEGIDIKLIYQYFYDTYFDVREGKMKNDPRELIKKEIKRVLEDYSYAINL

SEQ ID NO: 117 - protein, 408 aa, Artificial Sequence
  mutant D-fructose C4-epimerase
MWLSKDYLRKKGVYSICSSNPYVIEASIEFAKEKDDYILIEATPHQVNQFGGYTGMTPEDFKNFVMKIAKEKGLEEDKIILGGDHLGPLPWQDEPSETAMNKAKDLIRAFVESGYKKIHIDCSMPLSDDPKVLPQEKIAERTAELFEIAEETARKYNFQPVYVVGTDVPIAGGGEEEGVTSVEDFRSTISSLKKYFKDVPNIWDRVVGFVIMLGIGFSYDKVFEYDRDKVREILEEVKREDLFVEAHSTDYQARYALRNMVEDGVRILKVGPALTAAFRRAVFLLSDIEDEIIPPRERSNIKRVILETMLRDDRYWRKYYKDSKRLEFDIWYALLDRIRYYWEYEDVKAVLNKLFENFSEGVDIKFIYQYFPDSYFDVREGKMKNDPRELIKKEIKRVLEDYSYAINL

SEQ ID NO: 118 - protein, 408 aa, Artificial Sequence
  mutant D-fructose C4-epimerase
MWLSKDYLRKKGVYSICSSNPYVIEASIEFAKEKGDYILIEATPHQVNQFGGYSGMTPEDFKNFVMKIAKEKGLPEDKIILGGDHLGPLPWQDEPSEEAMAKAKDLIRAFVESGYKKIHIDCSMPLSDDPKVLPYEKIAERTVELFEIAEETARKYNFQPVYVVGTDVPIAGGGEEEGVTSPEDFRSAISSLKKYFNDVPNIWDRVVAFVIMLGIGFSYDKVFEYDRDKVRGILEEVKRTDLFVEVHSTDYQSRYALRNMVEDGVVILKVGPALTAAFRRGVFLLANIEDEIIPERERSNIKRVILETMLRDDRYWRKYYHDSKDLELDIWYNLLDRIRYYWEHEDVKMVLNKLFENFSEGVDIKLIYQYFYDSYFDVREGKMKNDPRELIKKEIKRVLEDYSYAINL

SEQ ID NO: 119 - protein, 408 aa, Artificial Sequence
  mutant D-fructose C4-epimerase
MWLSKDYLRKKGVYSICSSNSWVIEAAIEFAKEKGDYILIEATPHQVNQFGGYTGMTPEDFKNFVMKIAKEKGLPEDKIILGGDHLGPLPWQDEPAETAMAKAKDLIRAFVEAGYKKIHIDCSMPLADDPKVLPYEKIAERTAELFEIAEETARKYNFQPVYVVGTDVPIAGGGEEEGVTSVEDFRSAISSLKKYFNDVPNIWDRVVGFVIMLGIGFSYDKVFEYDRDKVREILEEVKRTDLFLEGHSTDYQARYALRNMVEDGVRILKVGPALTAAFRRGVFLLDNIEDEIIPERERSNIKRVILETMLRDDRYWRKYYKDSKRLELDIWYNLLDRIRYYWEYEDVKRALNKLFENFSEGVDIKFIYQYFYDSYFDVREGKMKNDPRELIKKEIKRVLEDYSYAINL

SEQ ID NO: 120 - protein, 408 aa, Artificial Sequence
  mutant D-fructose C4-epimerase
MWLSKDYLRKKGVYSICSSNPYVIEASIEFAKEKGSYILIEATPHQVNQFGGYTGMTPEDFKRFVMKIAKEKGLPEDKIILGGDHLGPLPWQHEPSDTAMEKAKDLIRAFVESGFKKIHIDCSMPCADDPKVLPNEKIAERTRELFRIAEETARKYNFQPVYVVGTDVPIAGGGEEEGVTSPEDFRRTISSLKKYFNDHPNIWDRVVGFVIMLGIGFSHDKVFEYDRDKVRGILEEVKREDLFVEAHSTDYQAREALRWMVEDGVAILKVGPALTAAFRRAVFLLSDIEDEIIPERERSNIKRVILETMLRDDRYWRKYYKDSDRLELDIHYSLLDRIRYYWEHEDVKAVLNKLFENFSDGVDIKFIYQYFYDSYFDVREGKLKNDPRELIKHEIKRVLEDYAYAINL

SEQ ID NO: 121 - protein, 408 aa, Artificial Sequence
  mutant D-fructose C4-epimerase
MWLSKDYLRKKGVYSICSSNSWVIEAAIEFAKEKGDYILIEATPHQVNQFGGYSGMTPEDFRRFVMKIAKEKGLEEDKIILGGDHLGPLPWQDEPAEEAMNKAKELIRAFVEAGYKKIHIDCSMPCADDPKVLPYEKIAERTRELFEIAERTARKYNFQPVYVVGTDVPIAGGGEEEGVTSPEDFRKAIEALKKYFADVPNIWDRVVGFVIMLGIGFSYDKVFEYDRDKVREILEEVKRTDLFVEGHSTDYQARDALRNMVEDGVRILKVGPALTAAFRRGVFLLANIEDEIIPEYRRSNIKEVILETMLRDDRYWRKYYKDSDRLELDIWYNLLDRIRYYWNYPDVKAALNKLFENLSEGVDIKLIYQYFYDSYFDVREGKMKNDPRELIKKEIKRVLEDYSYAINL

SEQ ID NO: 122 - protein, 408 aa, Artificial Sequence
  mutant D-fructose C4-epimerase
MWLSKDYLRKKGIYSICSSNPYVIEASIEFAKEDGDPILIEATPHQVNQFGGYSGMTPEDFKRFVYKIAKEKGLPEDKIILGGDHLGPLPWQDEPSDEAMNKAKDLIRAFVESGYKKIHIDCSMPCSDDPKVLPYEKIAERTRELFEIAEETARKYNFQPVYVVGTDVPIAGGGEEEGITSVEDFRSAIELHKKYFKDVPNIWDRVVGFVIMLGIGFSHDKVFEYDRDKVRDILEEVKREDLFVEGHSTDYQARYALRWMVEDGVAILKVGPALTAAFRRGVFLLSNIEDDIIPERERSNIKEVILETMLRDDRYWRKYYKDSDRLELDIWYSLLDRIRYYWEHEDVKMALNKLFENFSEGVPIKFIYQYFYDSYFDVREGKLKNDPRELIKHEIKRVLEDYSYAINL

SEQ ID NO: 123 - protein, 408 aa, Artificial Sequence
  mutant D-fructose C4-epimerase
MWLSKDYLRKKGVYSICSSNPWVIEAAIEFAKEKGDYILIEATPHQVNQFGGYTGMTPEDFKNFVMKIAKEKGLPEDKIILGGDHLGPLPWQDEPSETAMNKAKDLIRAFVESGYKKIHIDCSMPLSDDPKVLPYEKIAERTARLFEIAEETARKYNFQPVYVVGTDVPIAGGGEEEGVTSVEDFRSTISALKKYFNDHPNIWDRVVGFVIMLGIGFSHDKVFEYDRDKARGILEEVKREDLFVEGHSTDYQARYALRWMVEDGVRILKVGPALTAAFRRGVFLLADIEDEIIPERERSNIKRVILETMLRDDRYWRKYYKDSERLRLDIHYNLLDRIRYYWEHPDVKEVLNRLFENFSDGVDWKFIYQYFYDSYHDVREGKMKNDPRELIKKEIKRVLEDYSYAINL

SEQ ID NO: 124 - protein, 408 aa, Artificial Sequence
  mutant D-fructose C4-epimerase
MWLSKDYLRKKGVYSICSSNPWVIEASIEFAKEKGDPILIEATPHQVNQFGGYTGMTPEDFKNFVYKIAKEKGLEENKIILGGDHLGPLPWQDEPSETAMNKAKDLIRAFVESGYKKIHIDCSMPLADDPKVLPYEKIAERTRELFEIAEETARKYNFQPVYVVGTDVPIAGGGEEEGVTSVEDFRSTIEALKKYFNDVPNIWDRVVGFVIMLGIGFSHDKVFEYDRDKVREILEEVKRTDLFVEGHSTDYQARYALRNMVQDGVAILKVGPALTAAFRRGVFLLANIEDEIIPEYERSNIKRVILETMLRDDRYWRKYYKDSKRLELDIWYSLLDRIRYYWEHPDVKAALNKLFENFSEGVPITFIYQYFYDSYFDVREGKMKNDPRELIKKEIKRVLEDYAYAINL

SEQ ID NO: 125 - protein, 408 aa, Artificial Sequence
  mutant D-fructose C4-epimerase
MWLSKDYLRKKGVYSICSSNPYVIEASIEFAKEKGDYILIEATPHQVNQFGGYTGMTPEDFKNFVMKIAKEKGLEEDKIILGGDHLGPLPWQDEPAETAMKKAKDLIRAFVEAGYKKIHIDCSMPLSDDPKVLPKEKIAERTVELFEIAEETAQKYNFQPVYVVGTDVPIAGGGEEEGVTSKEDFRSFISTLKKYFDDVPNIWDRVVGFVIMLGIGFSYDKVFEYDRDKVREILEELKREDLFVEGHSTDYQDRQALRRMVEDGVRILKVGPALTAAFRRGIFLLANIEQELIPERERSNILRVILETMLRDDRYWRKYYKDSKRLELDIWYNLLDRIRYYWEHEDVKKVLNKLFENFSEGVDIKFIYQYFYDQYFDVREGKLKNDPRELIKKEIKRVLEDYSYAINL

SEQ ID NO: 126 - protein, 408 aa, Artificial Sequence
  mutant D-fructose C4-epimerase
MWLSKDYLRKKGVFSICSSNKYVIEAAIEFAKEMHDYILIEATPHQVNQFGGYSGMTPEDFKNFVMKIAKELGLPEDKIILGGDHLGPLPWQDEPAPTAMNKAKDLIRAFVESGYKKIHIDCSMPLSDDPKVLPYEKIAERTRELCEIAEETARKYNFQAVYVVGTDVPIAGGGEEEGVTSVEDFRTAISSLKKAFKDLPKIWDRVVGFVIMLGIGFSYDKVFEYDRDKVRGILEEVKREDLFVEGHSTDYQARKLLRNMVEDGVRILKVGPALTAAFRRAVFLLSNIEDEIIPERERSNILRVILETMLRDDRYWRKYYKDSKRLELDIWYNLLDRIRYYWEHEDVKMVLNKLFENFSEGVDIKFIYQYFYDQYFDVREGKMKNDPRELIKKEIKRVLEDYSYAINL

SEQ ID NO: 127 - protein, 408 aa, Artificial Sequence
  mutant D-fructose C4-epimerase
MWLSKDYLRKKGVYSICSSNSYVIEAAIEFAKEKDDYILIEATPHQVNQFGGYTGMTPEDFKNFVMKIAKEKGLPEDKIILGGDHLGPLPWQDEPAPTAMNKAKDLIRAFVESGFKKIHIDCSMPLSDDPKVLPYEKIAERTRELFKVAEEAARKYNFQAVYVVGTDVPIAGGGEEEGVTSVEDFRSMIEVLKKYFNDIPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKKVLNKLFENFSEGVDIKFIYQYFYDSYFDVREGKMKNDPRELIKKEIKRVLEDYSYAINL

SEQ ID NO: 128 - protein, 408 aa, Artificial Sequence
  mutant D-fructose C4-epimerase
MWLSKDYLRKKGVYSICSSNSYVIEASIEFAKEMGDPILIEATPHQVNQFGGYTGMTPEDFKNFVFKIAKEKGLPPDKIILGGDHLGPLPWQDEPAPTAMNKAKDLIRAFVESGYKKIHIDCSMPLSDDPKVLPYEKIAERTRELFEVAEEAARKYNFQPVYVVGTDVPIAGGGEEEGVTSPEDFRSAIDYFKKYFKDVPNAWDRVVGFVIMLGIGFSYDKVFEYDRDKVRGILEEVKREGLFVEGHSTDYQDRYALREMVEDGVRILKVGPALTAAFRRGVFLLANIEDEIIPEDKRSNIKRVILETMLRDDRYWRKYYKDSERLRLDIWYSLLDRIRYYWEHPDVKMALNKLFENFSEGVDIKFIYQYFPDSYFDVREGKMKNDPRELIKKEIKRVLEDYSYAINL

SEQ ID NO: 129 - protein, 408 aa, Artificial Sequence
  mutant D-fructose C4-epimerase
MWLSKDYLRKKGVYSICSSNSYVIEAAIEFAKEKGDYILIEATPHQVNQFGGYTGMTPEDFKNFVFKIAKEKGLPPDKIILGGDHLGPLPWQDEPSETAMNKAKELIRAFVEAGYKKIHIDCSMPLSDDPKVLPDEKIAERERELFKIAEETARKYNFQPVYVVGTDVPIAGGGEEEGITSVEDFRRFIESLKKYFNDVPNIWDRVVGFVIMLGIGFSYDKVFEYDRDKVRPILEEVKRTDLFVEGHSTDYQDRQALRNMVEDGVRILKVGPALTAAFRRAVFLLANIENEIIPERERSNIKRVILETMLRDDRYWRKYYKDSERLRLDIWYNYLDRIRYYWEYPDVKKVLNKLFENFSEGVDIKFIYQYFYDSYFDVREGKMKNDPRELIKKEIKRVLEDYSYAINL

SEQ ID NO: 130 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVFKIAKEKGLEEDKIILGGDHLGPLPWQDEPAPQAMEKAKELIRAFVESGYKKIHIDCSMPLSDDPKVLPPEKIAERTRELFEIAEETAQKYNFQPVYVVGTDVPIAGGGEEEGVTSPEEFRNMIESFKKYFDDVPNIWDRVVGFVIMLGIGFGYDKVFEYDRDKVRDILEEVKRTDLFVEGHSTDYQSRKALRNMVEDGVRILKVGPALTAAFRRGVFLLSNIENEIIPERKRSNIKRVILETMLRDDRYWRKYYKDSKRLRLDIWYNLLDRIRYYWEYPDVKAVLNKLFENFSEGVDIRFIYQYFYDSYFDVREGKMKNDPRELIKKEIKRVLEDYSYAINL

SEQ ID NO: 131 - protein, 408 aa, Artificial Sequence
  mutant D-fructose C4-epimerase
MWLSKDYLRKKGVYAICSSNPYVIEASIEFAKEKDDYILIEATPHQVNQFGGYTGMTPEDFKNFVMKIAKEKGLPEDKIILGGDHLGPLPWQDEPAPEAMAKAKDLIRAFVEAGYKKIHIDCSMPLSDDPAVLPYEKIAERTRELFEIAEETARKYNFQPVYVVGTDVPIAGGGEEEGVTSPEDFRSAISTLKKYFNDVPNIWDRVVGFVIMLGIGFSYDKVFEYDRDKVREILEEVKRTDLFVEAHSTDYQARYALRWMVEDGVVILKVGPALTAAFRRAVFLLSDIEAEIIPERERSNIKRVILETMLRDDRYWRKYYTDSDRLELDIWYNLLDRIRYYWEYEDVKKVLNKLFENFSDGIDIKFIYQYFYDAYHDVCEGKMKPDPRELIKKEIKRVLEDYAYAINL

SEQ ID NO: 132 - protein, 408 aa, Artificial Sequence
  mutant D-fructose C4-epimerase
MWLSKDYLRKKGVYSICSSNPYVIEASIEFAKEYGDYILIEATPHQVNQFGGYTGMTPEDFKRFVMKIAKEKGLEEDRIILGGDHLGPLPWQDEPAETAMAKAKDLIRAFVEAGYKKIHIDCSMPLSDDPKVLPYEKIAERTRELFKIAEETARKYNFQPVYVVGTDVPIAGGGEEEGVTSPEDFRSAIEVLKKYFEDHPNAWDRVVAFVIMLGIGFSYDKVFEYDRDKVREILEEVKREDLFVECHSTDYQAREALRNMVEDGVRILKVGPALTAAFRRAVFLLSDIEKEIIPERHRSNIKRVILETMLRDDRYWRKYYKDSDRLELDIWYNLLDRIRYYWEYEDVKAVLNKLFENFSEGVDIKFIYQYFYDCYFDVREGKMKNDPRELIKKEIKKVLEDYSYAINL

SEQ ID NO: 133 - protein, 408 aa, Artificial Sequence
  mutant D-fructose C4-epimerase
MWLSKDYLRKKGVYSICSSNPYVIEAAIEFAKEKGDYILIEATPHQVNQFGGYSGMTPEDFRNFVMKIAKEKGLPEDKIILGGDHLGPLPWQDEPSETAMNKAKDLIRAFVEAGYKKIHIDCSMPLADEPKVLPYEKIAERTAELFEIAEETARKYNFQPVYVVGTDVPIAGGGEEEGITSVEDFRSAISTLKKYFNDHPRIWDRVVGFVIMLGIGFSHDKVFEYDRDKVRGILEEVKRTDLFVEVHSTDYQPREALRNMVEDGVVILKVGPALTAAFRRGVFLLSDIEDEIIPEEERSNIKRVILETMLRDDRYWRKYYKDSKRLELDIWYNLLDRIRYYWEYEDVKAVLEKLFENFSEGVDIKFIYQYFPACYFDVREGKMKNDPRELIKKEIKRVLEDYSYAINL

SEQ ID NO: 134 - protein, 408 aa, Artificial Sequence
  mutant D-fructose C4-epimerase
MWLSKDYLRKKGVYSICSSNSWVIEASIEFAKEKGDYILIEATPHQVNQFGGYSGMTPEDFRRFVYQIAKEKGLPEDKIILGGDHLGPLPWQHEPAPTAMAKAKDLIRAYVESGFKKIHIDCSMPCSGDPKVLPYEKIAERTARLFEVAERTARKYNFQPVYVVGTDVPIAGGGEEEGVTSVEDFRKAIESLKKYFNDHPNAWDRVVGFVIMLGVGFSYDKVFEYDRDKVREILEEVKREPLFVEGHSTDYQARYALRNMVEDGVAILKVGPALTAAFRRAVFLLADIEKEIIPERHRSNIKEVILETMLRDDRYWRKYYRDSENLRLDIWYSLLDRIRYYWEHPDVKMVLNKLFENFSEGVDIKFIYQYFYDCYHAVREGKMKNDPRELIKKEIKRVLEDYSYAINL

SEQ ID NO: 135 - protein, 408 aa, Artificial Sequence
  mutant D-fructose C4-epimerase
MWLSKDYLRKKGIYSICSSNPWVIEAAIEHAKEDGDYILIEATPHQVNQFGGYTGMTPEDFKRFVMKIAKEKGLPEDKIILGGDHLGPLPWQHEPAEEAMEKAKELIRAYVESGFKKIHIDCSMPLSDDPAVLPYDKIAERTAELCRVAEETARKYNFQPVYVVGTDVPIAGGGEEEGVTSVEDFRKAISSFKKYFQDVPQIWNRVVGFVIMLGIGFSYDKVFEYDRDKVRDILEEVKREPLFVEGHSTDYQNRDALRNMVEDGVRILKVGPALTAAFREGVFLLADIEDEIIPEEQRSNIKRVILETMLRDDRYWRKYYKDSKQLRWDIWYSLLDRIRYYWNYEDVKMALEKLFENFSEGVPIKFIYQYFYDAYFDVREGKLKNDPRELIKKEIKRVLEDYSYAINL

SEQ ID NO: 136 - protein, 408 aa, Artificial Sequence
  mutant D-fructose C4-epimerase
MWLSKDYLRKKGIYSVCSSNPWVIEAAIEFAKEKGSYILIEATPHQVNQFGGYSGMTPEDFKNFVYKIAKEKGLEENKIILGGDHLGPLPWQHEPSPEAMAKAKDLIRAFVESGYKKIHIDCSMPCAGDPAVLPQEKIAERTRELCEIAEETARKYNFQPVYVVGTDVPIAGGGEEEGVTSPEDFRKAISSFKKYFNDHGNIWDRVVGFVIMLGIGFSYDKVFEYDRDKAREILEEVKRTDLFVEGHSTDYQARDALRNMVEDGVRILKVGPALTAAFRRAVFLLSNIEDEIIPERQRSNIKEVILETMLRDDRYWRKYYKDSKNLELDIHYSLLDRIRYYWNHEDVKMVLEKLFENFSEGIDWKFIYQYFYDSYRDVREGKMKNDPRELIKKEIKRVLEDYHYAINL

SEQ ID NO: 137 - protein, 408 aa, Artificial Sequence
  mutant D-fructose C4-epimerase
MWLSADYLRNKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYRKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIQRVILETMLRDDRYWRDYYDDSDRLELDIWYNLLDRIRYYWEYEDVRMVLNRLFENFSEGVDIRFIYQYFYDSYFDVREGRMKNDPRELIKKEIKRVLEDYSYAINL

SEQ ID NO: 138 - protein, 408 aa, Artificial Sequence
  mutant D-fructose C4-epimerase
MWLSKDYLRKLGVYSICSSNSYVIEASIEFALEMGDYILIEATPHQVNQFGGYSGMTPEDFKNFVMSIAQEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLQKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSERLELDIWYNLLDRIRYYWEYEDVLMVLNLLFENFSEGVDIKFIYQYFYDSYFDVREGKMKNDPRELIKKEIKRVLEDYSYAINL

SEQ ID NO: 139 - protein, 408 aa, Artificial Sequence
  mutant D-fructose C4-epimerase
MWLSKDYLRNKGVYSICSSNSYVIEASIEFAKEEGDYILIEATPHQVNQFGGYSGMTPEDFKNFVMKIAREKGLEEDKIILGGDHLGPLPWQDEPSPTAMNKAKDLIRAFVESGYKKIHIDCSMPLSDDPEVLPYEEIAERTRELFEIAEETAREYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYDDSDRLELDIWYNLLDRIRYYWEYEDVRMVLNKLFENFSEGVDIKFIYQYFYDSYFDVREGRMDNDPRELIKKEIKRVLEDYSYAINL

SEQ ID NO: 140 - protein, 408 aa, Artificial Sequence
  mutant D-fructose C4-epimerase
MWLSFDYLRMLGVYSICSSNSYVIEASIEFAKEKGDYILIEATPHQVNQFGGYSGMTPEDFVNFVMKIAREKGLEEDKIILGGDHLGPLPWQDEPSPTAMNKAKDLIRAFVESGYIKIHIDCSMPLSDDPEVLPYEKIAERTRELFEIAEETARKYNFQPVYVVGTDVPIAGGGEEEGVTSVEDFRSAISSLKAYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYDDSDRLELDIWYNLLDRIRYYWEYEDVKMVLNLLFENFSEGVDIKFIYQYFYDSYFDVREGKMSNDPRELIKKEIKRVLEDYSYAINL

SEQ ID NO: 141 - protein, 408 aa, Artificial Sequence
  mutant D-fructose C4-epimerase
MWLSKDYLRKLGVYSICSSNSYVIEASIEFAKEKGDYILIEATPHQVNQFGGYSGMTPEDFKNFVMKIAQEKGLEEDLIILGGDHLGPLPWQDEPSPTAMNKAKDLIRAFVESGYKKIHIDCSMPLSDDPKVLPYELIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIKRVILETMLRDDRYWRKYYDDSKRLELDIWYNLLDRIRYYWEYEDVKMVLNKLFENFSEGVDISFIYQYFYDSYFDVREGKMKNDPRELIKKEIKRVLEDYSYAINL

SEQ ID NO: 142 - protein, 408 aa, Artificial Sequence
  mutant D-fructose C4-epimerase
MWLSKDYLRNKGVYSICSSNSYVIEASIEFAKEKGDYILIEATPHQVNQFGGYSGMTPEDFKNFVMKIAREKGLEEDKIILGGDHLGPLPWQDEPSPTAMNKARDLIRAFVESGYKKIHIDCSMPLSDDPKVLPYEKIAERTRELFEIAEETAREYNFQPVYVVGTDVPIAGGGEEEGVTSVEDFRSAISSLAKYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIKRVILETMLRDDRYWRKYYDDSKRLELDIWYNLLDRIRYYWEYEDVKMVLNLLFENFSEGVDIKFIYQYFYDSYFDVREGRMTNDPRELIKKEIKRVLEDYSYAINL

SEQ ID NO: 143 - protein, 408 aa, Artificial Sequence
  mutant D-fructose C4-epimerase
MWLSLDYLRKKGVYSIGSSNSYVIEASIEFAKEMGDYILIEATPHQVNQFGGYSGMTPEDFKNFVMKIAKELGLEEDLIILGGDHLGPLPWQDEPSPTAMNYAKDLIRAFVESGYKKIHIDCSMPLSDDPKVLPYEKIAERTRELFEIAEETARKYNFQPVYVVGTDVPIAGGGEEEGVTSVEDFRSAISSLQKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYDDSERLELDIWYNLLDRIRYYWEYEDVKMVLNKLFENFSEGVDIKFIYQYFYDSYFDVREGKMKNDPRELIKKEIKRVLEDYSYAINL

SEQ ID NO: 144 - protein, 408 aa, Artificial Sequence
  mutant D-fructose C4-epimerase
MWLSKDYLRNKGVYSITSSNSYVIEASIEFAKETGDYILIEATPHQVNQFGGYSGMTPEDFRNFVMKIAKELGLEEDKIILGGDHLGPLPWQDEPSPTAMNKAKDLIRAFVESGYHKIHIDTSMPLSDDPQVLPYETIAERTRELFEIAEETARKYNFQPVYVVGTDVPIAGGGEEEGVTSVEDFRSAISSLEEYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYDDSDRLELDIWYNLLDRIRYYWEYEDVKMVLNKLFENFSEGVDIKFIYQYFYDSYFDVREGRMKNDPRELIKKEIKRVLEDYSYAINL

SEQ ID NO: 145 - protein, 408 aa, Artificial Sequence
  mutant D-fructose C4-epimerase
MWLSKDYLRKKGVYSITSSNSYVIEASIEFAKEQGDYILIEATPHQVNQFGGYSGMTPEDFRNFVMKIAREVGLEEDKIILGGDHLGPLPWQDEPSPTAMNKAKDLIRAFVESGYKKIHIDCSMPLSDDPQVLPYEKIAERTRELFEIAEETARRYNFQPVYVVGTDVPIAGGGEEEGVTSVEDFRSAISSLKTYFNDVPNIWDRVVGFVIMLGIGFSYDKVFEYDRDRVRGILEEVSREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIRFIYQYFYDSYFDVREGKMKNDPRELIKKEIKRVLEDYSYAINL

SEQ ID NO: 146 - protein, 408 aa, Artificial Sequence
  mutant D-fructose C4-epimerase
MWLSKDYLRRKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPQVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDTVRGILEEVKREDLFVEGHSTDYQARYALRNMVEDGVRILKVGPALTAAFRRGVFLLSNIEDEIIPERERSNIKRVILETMLRDDRYWRKYYDDSKRLELDIWYNLLDRIRYYWEYEDVRMVLNRLFENFSEGVDIKFIYQYFYDSYFDVREGRMKNDPRELIKKEIKRVLEDYSYAINL

SEQ ID NO: 147 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMTIAKEKGLEEDLIILGGDHLGPLPWQDEPSPTAMNYAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIRFIYQYFYDSYFDVREGKMKNDPRELIKKEIKRVLEDYSYAINL

SEQ ID NO: 148 - protein, 408 aa, Artificial Sequence
  mutant D-fructose C4-epimerase
MWLSKDYLRNLGVYSITSSNSYVIEASIEFAMELGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYELIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMSNDPRELIKKEIKRVLEDYSYAINL

SEQ ID NO: 149 - protein, 408 aa, Artificial Sequence
  mutant D-fructose C4-epimerase
MWLSKDYLRNKGVYSITSSNSYVIEASIEFAMELGDYILIEATPHQVNQFGGYSGMTPEDFKNFVMKIAREKGLEEDKIILGGDHLGPLPWQDEPSPTAMNLAKDLIRAFVESGYKKIHIDCSMPLSDDPYVLPYELIAERTRELFEIAEETARKYNFQPVYVVGTDVPIAGGGEEEGVTSVEDFRSAISSLQKYFNDVPNIWDRVVGFVIMLGIGFSYDVVFEYDRDRVRGILEEVSREDLFVEGHSTDYQARYALRNMVEDGVRILKVGPALTAAFRRGVFLLSNIEDEIIPERERSNIKRVILETMLRDDRYWRKYYDDSKRLELDIWYNLLDRIRYYWEYEDVKMVLNKLFENFSEGVDIKFIYQYFYDSYFDVREGRMKNDPRELIKHEIKRVLEDYSYAINL

SEQ ID NO: 150 - protein, 408 aa, Artificial Sequence
  mutant D-fructose C4-epimerase
MWLSWDYLRRKGVYSICSSNSYVIEASIEFAMEKGDYILIEATPHQVNQFGGYSGMTPEDFKNFVMQIAREKGLEEDMIILGGDHLGPLPWQDEPSPTAMNKAKDLIRAFVESGYKKIHIDCSMPLSDDPQVLPYEKIAERTRELFEIAEETARKYNFQPVYVVGTDVPIAGGGEEEGVTSVEDFRSAISSLIKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVLMVLNKLFENFSEGVDIKFIYQYFYDSYFDVREGKMKNDPRELIKKEIKRVLEDYSYAINL

SEQ ID NO: 151 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAREKGLEEDKIILGGDHLGPLPWQDEPSPTAMNKANDLIRAFVESGYKLIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDRVFEYDRDTVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVRMVLNQLFENFSEGVDIKFIYQYFYDSYFDVREGKMDNDPRELIKKEIKRVLEDYSYAINL

SEQ ID NO: 152 - protein, 408 aa, Artificial Sequence
  mutant D-fructose C4-epimerase
MWLSKDYLRKQGVYSICSSNSYVIEASIEFAKEQGDYILIEATPHQVNQFGGYSGMTPEDFRNFVMTIAKEKGLEEDKIILGGDHLGPLPWQDEPSPTAMNKAQDLIRAFVESGYKKIHIDCSMPLSDDPEVLPYETIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNRLFENFSEGVDIKFIYQYFYDSYFDVREGKMENDPRELIKKEIKRVLEDYSYAINL

SEQ ID NO: 153 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDLIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNIIRVILETMLRDDRYWRKYYKDSKRLELDIWYNLLDRIRYYWEYEDVKMVLNKLFENFSEGVDISFIYQYFYDSYFDVREGKMKNDPRELIKKEIKRVLEDYSYAINL

SEQ ID NO: 154 - protein, 408 aa, Artificial Sequence
  mutant D-fructose C4-epimerase
MWLSMDYLRLKGVYSICSSNSYVIEASIEFAKEKGDYILIEATPHQVNQFGGYSGMTPEDFKNFVMTIARELGLEEDKIILGGDHLGPLPWQDEPSPTAMNKAKDLIRAFVESGYKKIHIDCSMPLSDDPQVLPYELIAERTRELFEIAEETARKYNFQPVYVVGTDVPIAGGGEEEGVTSVEDFRSAISSLKKYFNDVPNIWDRVVGFVIMLGIGFSYDRVFEYDRDKVRGILEEVKREDLFVEGHSTDYQARYALRNMVEDGVRILKVGPALTAAFRRGVFLLSNIEDEIIPERERSNIKRVILETMLRDDRYWRDYYKDSKRLELDIWYNLLDRIRYYWEYEDVKMVLNWLFENFSEGVDIHFIYQYFYDSYFDVREGKMDNDPRELIRKEIMRVLEDYSYAINL

SEQ ID NO: 155 - protein, 408 aa, Artificial Sequence
  mutant D-fructose C4-epimerase
MWLSKDYLRKKGVYSITSSNSYVIEASIEFAKEKGDYILIEATPHQVNQFGGYSGMTPEDFKNFVMTIAREKGLEEDKIILGGDHLGPLPWQDEPSPTAMNRANDLIRAFVESGYKKIHIDCSMPLSDDPKVLPYEKIAERTRELFEIAEETARNYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 156 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKARDLIRAFVESGYKKIHIDCSMPLSDDPRVLPYEKIAERTRELFEIAEETARKYNFQPVYVVGTDVPIAGGGEEEGVTSVEDFRSAISSLEKYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVLMVLNKLFENFSEGVDIKFIYQYFYDSYFDVREGKMKNDPRELIKKEIKRVLEDYSYAINL

SEQ ID NO: 157 - protein, 408 aa, Artificial Sequence
  mutant D-fructose C4-epimerase
MWLSHDYLRKKGVYSICSSNSYVIEASIEFAKEKGDYILIEATPHQVNQFGGYSGMTPEDFKNFVMTIAKEKGLEEDLIILGGDHLGPLPWQDEPSPTAMNKAKDLIRAFVESGYKWIHIDASMPLSDDPKVLPYEKIAERTRELFEIAEETARNYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNILRVILETMLRDDRYWRDYYKDSKRLELDIWYNLLDRIRYYWEYEDVKMVLNLLFENFSEGVDIKFIYQYFYDSYFDVREGKMSNDPRELIKKEILRVLEDYSYAINL

SEQ ID NO: 158 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFRNFVMTIAKEKGLEEDKIILGGDHLGPLPWQDEPSPTAMNKANDLIRAFVESGYKKIHIDCSMPLSDDPQVLPYEQIAERTRELFEIAEETARKYNFQPVYVVGTDVPIAGGGEEEGVTSVEDFRSAISSLKKYFNDVPNIWDRVVGFVIMLGIGFSYDRVFEYDRDKVRGILEEVSREDLFVEGHSTDYQARYALRNMVEDGVRILKVGPALTAAFRRGVFLLSNIEDEIIPERERSNIKRVILETMLRDDRYWRKYYKDSSRLELDIWYNLLDRIRYYWEYEDVKMVLNKLFENFSEGVDIKFIYQYFYDSYFDVREGRMKNDPRELIKKEIKRVLEDYSYAINL

SEQ ID NO: 159 - protein, 408 aa, Artificial Sequence
  mutant D-fructose C4-epimerase
MWLSLDYLRNQGVYSICSSNSYVIEASIEFAKEKGDYILIEATPHQVNQFGGYSGMTPEDFRNFVMTIAREKGLEEDKIILGGDHLGPLPWQDEPSPTAMNKAKDLIRAFVESGYKKIHIDCSMPLSDDPQVLPYEQIAERTRELFEIAEETARKYNFQPVYVVGTDVPIAGGGEEEGVTSVEDFRSAISSLEEYFNDVPNIWDRVVGFVIMLGIGFSYDRVFEYDRDKVRGILEEVKREDLFVEGHSTDYQARYALRNMVEDGVRILKVGPALTAAFRRGVFLLSNIEDEIIPERERSNIRRVILETMLRDDRYWRKYYDDSDRLELDIWYNLLDRIRYYWEYEDVRMVLNKLFENFSEGVDIKFIYQYFYDSYFDVREGRMDNDPRELIKKEIKRVLEDYSYAINL

SEQ ID NO: 160 - protein, 408 aa, Artificial Sequence
  mutant D-fructose C4-epimerase
MWLSKDYLRNKGVYSITSSNSYVIEASIEFAKEKGDYILIEATPHQVNQFGGYSGMTPEDFKNFVMKIAREKGLEEDKIILGGDHLGPLPWQDEPSPTAMNKARDLIRAFVESGYKKIHIDASMPLSDDPEVLPYEEIAERTRELFEIAEETAREYNFQPVYVVGTDVPIAGGGEEEGVTSVEDFRSAISSLEKYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNIKRVILETMLRDDRYWRKYYDDSDRLELDIWYNLLDRIRYYWEYEDVRMVLNRLFENFSEGVDIKFIYQYFYDSYFDVREGKMKNDPRELIKKEIKRVLEDYSYAINL

SEQ ID NO: 161 - protein, 408 aa, Artificial Sequence
  mutant D-fructose C4-epimerase
MWLSHDYLRKVGVYSICSSNSYVIEASIEFAKEKGDYILIEATPHQVNQFGGYSGMTPEDFKNFVMKIAKELGLEEDKIILGGDHLGPLPWQDEPSPTAMNKAKDLIRAFVESGYTKIHIDTSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSERLELDIWYNLLDRIRYYWEYEDVKMVLNKLFENFSEGVDIKFIYQYFYDSYFDVREGLMENDPRELIKYEIKRVLEDYSYAINL

SEQ ID NO: 162 - protein, 408 aa, Artificial Sequence
  mutant D-fructose C4-epimerase
MWLSFDYLRNQGVYSIASSNSYVIEASIEFAQEQGDYILIEATPHQVNQFGGYSGMTPEDFKNFVMTIAKELGLEEDKIILGGDHLGPLPWQDEPSPTAMNKAKDLIRAFVESGYKKIHIDCSMPLSDDPKVLPYETIAERTRELFEIAEETARKYNFQPVYVVGTDVPIAGGGEEEGVTSVEDFRSAISSLKKYFNDVPNIWDRVVGFVIMLGIGFSYDKVFEYDRDRVRGILEEVSREDLFVEGHSTDYQARYALRNMVEDGVRILKVGPALTAAFRRGVFLLSNIEDEIIPERERSNIKRVILETMLRDDRYWRDYYDDSDRLELDIWYNLLDRIRYYWEYEDVRMVLNQLFENFSEGVDIKFIYQYFYDSYFDVREGKMKNDPRELIKKEIKRVLEDYSYAINL

SEQ ID NO: 163 - protein, 408 aa, Artificial Sequence
  mutant D-fructose C4-epimerase
MWLSFDYLRKKGVYSICSSNSYVIEASIEFAKEQGDYILIEATPHQVNQFGGYSGMTPEDFKNFVMKIAKETGLEEDQIILGGDHLGPLPWQDEPSPTAMNKAKDLIRAFVESGYKKIHIDCSMPLSDDPKVLPYETIAERTRELFEIAEETARNYNFQPVYVVGTDVPIAGGGEEEGVTSVEDFRSAISSLKKYFNDVPNIWDRVVGFVIMLGIGFSYDTVFEYDRDKVRGILEEVSREDLFVEGHSTDYQARYALRNMVEDGVRILKVGPALTAAFRRGVFLLSNIEDEIIPERERSNIRRVILETMLRDDRYWRKYYKDSDRLELDIWYNLLDRIRYYWEYEDVKMVLNKLFENFSEGVDIKFIYQYFYDSYFDVREGRMKNDPRELIKKEIKRVLEDYSYAINL

SEQ ID NO: 164 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFVNFVMKIAREKGLEEDLIILGGDHLGPLPWQDEPSPTAMNKAQDLIRAFVESGYIKIHIDCSMPLSDDPKVLPYEKIAERTRELFEIAEETARNYNFQPVYVVGTDVPIAGGGEEEGVTSVEDFRSAISSLQKYFNDVPNIWDRVVGFVIMLGIGFSYDVVFEYDRDRVRGILEEVKREDLFVEGHSTDYQARYALRNMVEDGVRILKVGPALTAAFRRGVFLLSNIEDEIIPERERSNIKRVILETMLRDDRYWRKYYDDSDRLELDIWYNLLDRIRYYWEYEDVLMVLNKLFENFSEGVDIKFIYQYFYDSYFDVREGRMKNDPRELIKHEIKRVLEDYSYAINL

SEQ ID NO: 165 - protein, 408 aa, Artificial Sequence
  mutant D-fructose C4-epimerase
MWLSWDYLRRKGVYSITSSNSYVIEASIEFAKEKGDYILIEATPHQVNQFGGYSGMTPEDFRNFVMTIARELGLEEDRIILGGDHLGPLPWQDEPSPTAMNKARDLIRAFVESGYRKIHIDCSMPLSDDPKVLPYEEIAERTRELFEIAEETARKYNFQPVYVVGTDVPIAGGGEEEGVTSVEDFRSAISSLRTYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIQRVILETMLRDDRYWRKYYDDSKRLELDIWYNLLDRIRYYWEYEDVRMVLNRLFENFSEGVDIRFIYQYFYDSYFDVREGKMENDPRELIKKEIKRVLEDYSYAINL

SEQ ID NO: 166 - protein, 408 aa, Artificial Sequence
  mutant D-fructose C4-epimerase
MWLSKDYLRLYGVYSICSSNSYVIEASIEFAKETGDYILIEATPHQVNQFGGYSGMTPEDFVNFVMTIAKEKGLEEDKIILGGDHLGPLPWQDEPSPTAMNYAKDLIRAFVESGYYKIHIDCSMPLSDDPQVLPYELIAERTRELFEIAEETARYYNFQPVYVVGTDVPIAGGGEEEGVTSVEDFRSAISSLAAYFNDVPNIWDRVVGFVIMLGIGFSYDRVFEYDRDKVRGILEEVSREDLFVEGHSTDYQARYALRNMVEDGVRILKVGPALTAAFRRGVFLLSNIEDEIIPERERSNIKRVILETMLRDDRYWRDYYKDSKRLELDIWYNLLDRIRYYWEYEDVKMVLNWLFENFSEGVDIKFIYQYFYDSYFDVREGRMLNDPRELIKKEIKRVLEDYSYAINL

SEQ ID NO: 167 - protein, 408 aa, Artificial Sequence
  mutant D-fructose C4-epimerase
MWLSADYLRKQGVYSITSSNSYVIEASIEFAQEEGDYILIEATPHQVNQFGGYSGMTPEDFKNFVMTIARELGLEEDKIILGGDHLGPLPWQDEPSPTAMNRARDLIRAFVESGYKKIHIDCSMPLSDDPEVLPYEKIAERTRELFEIAEETAREYNFQPVYVVGTDVPIAGGGEEEGVTSVEDFRSAISSLKKYFNDVPNIWDRVVGFVIMLGIGFSYDKVFEYDRDRVRGILEEVSREDLFVEGHSTDYQARYALRNMVEDGVRILKVGPALTAAFRRGVFLLSNIEDEIIPERERSNIQRVILETMLRDDRYWRDYYDDSDRLELDIWYNLLDRIRYYWEYEDVKMVLNRLFENFSEGVDIKFIYQYFYDSYFDVREGKMTNDPRELIKKEIKRVLEDYSYAINL

SEQ ID NO: 168 - protein, 408 aa, Artificial Sequence
  mutant D-fructose C4-epimerase
MWLSADYLRNKGVYSICSSNSYVIEASIEFAKEKGDYILIEATPHQVNQFGGYSGMTPEDFKNFVMTIAREKGLEEDQIILGGDHLGPLPWQDEPSPTAMNRAKDLIRAFVESGYKKIHIDCSMPLSDDPEVLPYEEIAERTRELFEIAEETAREYNFQPVYVVGTDVPIAGGGEEEGVTSVEDFRSAISSLETYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNIKRVILETMLRDDRYWRKYYDDSKRLELDIWYNLLDRIRYYWEYEDVRMVLNRLFENFSEGVDIRFIYQYFYDSYFDVREGKMKNDPRELIKKEIKRVLEDYSYAINL

SEQ ID NO: 169 - protein, 408 aa, Artificial Sequence
  mutant D-fructose C4-epimerase
MWLSFDYLRNQGVYSIISSNSYVIEASIEFAKEQGDYILIEATPHQVNQFGGYSGMTPEDFRNFVMTIAREKGLEEDKIILGGDHLGPLPWQDEPSPTAMNKAQDLIRAFVESGYKKIHIDTSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDTVFEYDRDKVRGILEEVSREDLFVEGHSTDYQARYALRNMVEDGVRILIVGPALTAAFRRGVFLLSNIEDEIIPERERSNIKRVILETMLRDDRYWRDYYDDSDRLELDIWYNLLDRIRYYWEYEDVRMVLNQLFENFSEGVDIKFIYQYFYDSYFDVREGRMENDPRELIKKEIKRVLEDYSYAINL

SEQ ID NO: 170 - protein, 408 aa, Artificial Sequence
  mutant D-fructose C4-epimerase
MWLSADYLRKKGVYSICSSNSYVIEASIEFAIEKGDYILIEATPHQVNQFGGYSGMTPEDFYNFVMTIAKELGLEEDKIILGGDHLGPLPWQDEPSPTAMNKAKDLIRAFVESGYLKIHIDCSMPLSDDPKVLPYEKIAERTRELFEIAEETARKYNFQPVYVVGTDVPIAGGGEEEGVTSVEDFRSAISSLATYFNDVPNIWDRVVGFVIMLGIGFSYDIVFEYDRDRVRGILEEVSREDLFVEGHSTDYQARYALRNMVEDGVRILKVGPALTAAFRRGVFLLSNIEDEIIPERERSNIIRVILETMLRDDRYWRDYYDDSKRLELDIWYNLLDRIRYYWEYEDVKMVLNLLFENFSEGVDIKFIYQYFYDSYFDVREGRMTNDPRELIKKEIKRVLEDYSYAINL

SEQ ID NO: 171 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAREKGLEEDLIILGGDHLGPLPWQDEPSPTAMNYAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILLVGPALTAAFRRGVFLLSNIEDEIIPERERSNIKRVILETMLRDDRYWRKYYKDSKRLELDIWYNLLDRIRYYWEYEDVVMVLNKLFENFSEGVDIRFIYQYFYDSYFDVREGKMKNDPRELIMLEIKRVLEDYSYAINL

SEQ ID NO: 172 - protein, 408 aa, Artificial Sequence
  mutant D-fructose C4-epimerase
MWLSFDYLRKQGVYSICSSNSYVIEASIEFAQEKGDYILIEATPHQVNQFGGYSGMTPEDFRNFVMKIAKEKGLEEDQIILGGDHLGPLPWQDEPSPTAMNKAKDLIRAFVESGYQKIHIDCSMPLSDDPKVLPYETIAERTRELFEIAEETARKYNFQPVYVVGTDVPIAGGGEEEGVTSVEDFRSAISSLKKYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNIKRVILETMLRDDRYWRDYYDDSDRLELDIWYNLLDRIRYYWEYEDVRMVLNQLFENFSEGVDIKFIYQYFYDSYFDVREGKMDNDPRELIKKEIKRVLEDYSYAINL

SEQ ID NO: 173 - protein, 408 aa, Artificial Sequence
  mutant D-fructose C4-epimerase
MWLSFDYLRMKGVYSICSSNSYVIEASIEFAKELGDYILIEATPHQVNQFGGYSGMTPEDFKNFVMTIAREKGLEEDLIILGGDHLGPLPWQDEPSPTAMNKARDLIRAFVESGYKKIHIDCSMPLSDDPEVLPYEKIAERTRELFEIAEETARKYNFQPVYVVGTDVPIAGGGEEEGVTSVEDFRSAISSLQRYFNDVPNIWDRVVGFVIMLGIGFSYDVVFEYDRDKVRGILEEVWREDLFVEGHSTDYQARYALRNMVEDGVRILKVGPALTAAFRRGVFLLSNIEDEIIPERERSNIKRVILETMLRDDRYWRKYYKDSDRLELDIWYNLLDRIRYYWEYEDVKMVLNWLFENFSEGVDISFIYQYFYDSYFDVREGKMSNDPRELIKKEIKRVLEDYSYAINL

SEQ ID NO: 174 - protein, 408 aa, Artificial Sequence
  mutant D-fructose C4-epimerase
MWLSKDYLRKYGVYSICSSNSYVIEASIEFAKELGDYILIEATPHQVNQFGGYSGMTPEDFKNFVMKIAREKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDIVFEYDRDRVRGILEEVSREDLFVEGHSTDYQARYALRNMVEDGVRILKVGPALTAAFRRGVFLLSNIEDEIIPERERSNIKRVILETMLRDDRYWRDYYKDSDRLELDIWYNLLDRIRYYWEYEDVVMVLNKLFENFSEGVDIRFIYQYFYDSYFDVREGKMKNDPRELIKLEIKRVLEDYSYAINL

SEQ ID NO: 175 - protein, 408 aa, Artificial Sequence
  mutant D-fructose C4-epimerase
MWLSKDYLRKKGVYSICSSNSYVIEASIEFAIEKGDYILIEATPHQVNQFGGYSGMTPEDFVNFVMKIAKEKGLEEDKIILGGDHLGPLPWQDEPSPTAMNKAIDLIRAFVESGYKKIHIDTSMPLSDDPKVLPYELIAERTRELFEIAEETARKYNFQPVYVVGTDVPIAGGGEEEGVTSVEDFRSAISSLKAYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNIKRVILETMLRDDRYWRDYYKDSKRLELDIWYNLLDRIRYYWEYEDVKMVLNLLFENFSEGVDISFIYQYFYDSYFDVREGKMENDPRELILKEIKRVLEDYSYAINL

SEQ ID NO: 176 - protein, 408 aa, Artificial Sequence
  mutant D-fructose C4-epimerase
MWLSKDYLRKVGVYSICSSNSYVIEASIEFALEYGDYILIEATPHQVNQFGGYSGMTPEDFVNFVMRIAQEKGLEEDRIILGGDHLGPLPWQDEPSPTAMNLAKDLIRAFVESGYTKIHIDCSMPLSDDPRVLPYEKIAERTRELFEIAEETAREYNFQPVYVVGTDVPIAGGGEEEGVTSVEDFRSAISSLKAYFNDVPNIWDRVVGFVIMLGIGFSYDIVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVLMVLNKLFENFSEGVDIRFIYQYFYDSYFDVREGLMKNDPRELIKKEIKRVLEDYSYAINL

SEQ ID NO: 177 - protein, 408 aa, Artificial Sequence
  mutant D-fructose C4-epimerase
MWLSKDYLRKKGVYSICSSNSYVIEASIEFALEMGDYILIEATPHQVNQFGGYSGMTPEDFKNFVMSIAKEKGLEEDQIILGGDHLGPLPWQDEPSPTAMNLAKDLIRAFVESGYTKIHIDCSMPLSDDPKVLPYEKIAERTRELFEIAEETARKYNFQPVYVVGTDVPIAGGGEEEGVTSVEDFRSAISSLKSYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIIRVILETMLRDDRYWRKYYDDSKRLELDIWYNLLDRIRYYWEYEDVLMVLNLLFENFSEGVDIKFIYQYFYDSYFDVREGLMKNDPRELIKKEIKRVLEDYSYAINL

SEQ ID NO: 178 - protein, 408 aa, Artificial Sequence
  mutant D-fructose C4-epimerase
MWLSKDYLRLYGVYSITSSNSYVIEASIEFAKEKGDYILIEATPHQVNQFGGYSGMTPEDFYNFVMTIARELGLEEDKIILGGDHLGPLPWQDEPSPTAMNKAKDLIRAFVESGYKMIHIDVSMPLSDDPQVLPYELIAERTRELFEIAEETARYYNFQPVYVVGTDVPIAGGGEEEGVTSVEDFRSAISSLAKYFNDVPNIWDRVVGFVIMLGIGFSYDRVFEYDRDTVRGILEEVKREDLFVEGHSTDYQARYALRNMVEDGVRILVVGPALTAAFRRGVFLLSNIEDEIIPERERSNIKRVILETMLRDDRYWRDYYDDSDRLELDIWYNLLDRIRYYWEYEDVKMVLNWLFENFSEGVDIHFIYQYFYDSYFDVREGRMKNDPRELILKEIMRVLEDYSYAINL

SEQ ID NO: 179 - protein, 408 aa, Artificial Sequence
  mutant D-fructose C4-epimerase
MWLSKDYLRNVGVYSIGSSNSYVIEASIEFALEKGDYILIEATPHQVNQFGGYSGMTPEDFKNFVMSIAKEKGLEEDLIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLEKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIIRVILETMLRDDRYWRDYYKDSKRLELDIWYNLLDRIRYYWEYEDVKMVLNLLFENFSEGVDIRFIYQYFYDSYFDVREGKMTNDPRELILKEIKRVLEDYSYAINL

SEQ ID NO: 180 - protein, 408 aa, Artificial Sequence
  mutant D-fructose C4-epimerase
MWLSKDYLRNLGVYSICSSNSYVIEASIEFALEKGDYILIEATPHQVNQFGGYSGMTPEDFKNFVMKIAKEKGLEEDQIILGGDHLGPLPWQDEPSPTAMNKARDLIRAFVESGYTKIHIDCSMPLSDDPEVLPYEKIAERTRELFEIAEETARKYNFQPVYVVGTDVPIAGGGEEEGVTSVEDFRSAISSLKRYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVLMVLNLLFENFSEGVDISFIYQYFYDSYFDVREGLMENDPRELIKKEIKRVLEDYSYAINL

SEQ ID NO: 181 - protein, 408 aa, Artificial Sequence
  mutant D-fructose C4-epimerase
MWLSLDYLRKKGVYSICSSNSYVIEASIEFAKEKGDYILIEATPHQVNQFGGYSGMTPEDFKNFVMKIAKELGLEEDLIILGGDHLGPLPWQDEPSPTAMNKAKDLIRAFVESGYKKIHIDCSMPLSDDPKVLPYELIAERTRELFEIAEETAREYNFQPVYVVGTDVPIAGGGEEEGVTSVEDFRSAISSLKKYFNDVPNIWDRVVGFVIMLGIGFSYDKVFEYDRDKVRGILEEVSREDLFVEGHSTDYQARYALRNMVEDGVRILKVGPALTAAFRRGVFLLSNIEDEIIPERERSNILRVILETMLRDDRYWRKYYDDSKRLELDIWYNLLDRIRYYWEYEDVKMVLNKLFENFSEGVDISFIYQYFYDSYFDVREGKMKNDPRELIKYEIKRVLEDYSYAINL

SEQ ID NO: 182 - protein, 408 aa, Artificial Sequence
  mutant D-fructose C4-epimerase
MWLSMDYLRLLGVYSITSSNSYVIEASIEFAMELGDYILIEATPHQVNQFGGYSGMTPEDFKNFVMKIARELGLEEDLIILGGDHLGPLPWQDEPSPTAMNLAKDLIRAFVESGYIKIHIDCSMPLSDDPKVLPYEKIAERTRELFEIAEETARNYNFQPVYVVGTDVPIAGGGEEEGVTSVEDFRSAISSLKSYFNDVPNIWDRVVGFVIMLGIGFSYDVVFEYDRDKVRGILEEVSREDLFVEGHSTDYQARYALRNMVEDGVRILKVGPALTAAFRRGVFLLSNIEDEIIPERERSNIKRVILETMLRDDRYWRDYYDDSDRLELDIWYNLLDRIRYYWEYEDVLMVLNKLFENFSEGVDIKFIYQYFYDSYFDVREGRMKNDPRELIKKEIKRVLEDYSYAINL

SEQ ID NO: 183 - protein, 408 aa, Artificial Sequence
  mutant D-fructose C4-epimerase
MWLSKDYLRNLGVYSICSSNSYVIEASIEFAMELGDYILIEATPHQVNQFGGYSGMTPEDFVNFVMTIAKEKGLEEDLIILGGDHLGPLPWQDEPSPTAMNLAKDLIRAFVESGYIKIHIDCSMPLSDDPYVLPYELIAERTRELFEIAEETARNYNFQPVYVVGTDVPIAGGGEEEGVTSVEDFRSAISSLQRYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNILRVILETMLRDDRYWRDYYDDSDRLELDIWYNLLDRIRYYWEYEDVLMVLNWLFENFSEGVDIKFIYQYFYDSYFDVREGRMSNDPRELIKKEIKRVLEDYSYAINL

SEQ ID NO: 184 - protein, 408 aa, Artificial Sequence
  mutant D-fructose C4-epimerase
MWLSKDYLRKKGVYSIGSSNSYVIEASIEFAKEMGDYILIEATPHQVNQFGGYSGMTPEDFKNFVMKIAQEKGLEEDKIILGGDHLGPLPWQDEPSPTAMNKARDLIRAFVESGYKKIHIDCSMPLSDDPRVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIIRVILETMLRDDRYWRKYYKDSKRLELDIWYNLLDRIRYYWEYEDVLMVLNKLFENFSEGVDIRFIYQYFYDSYFDVREGKMQNDPRELIKYEIKRVLEDYSYAINL

SEQ ID NO: 185 - protein, 408 aa, Artificial Sequence
  mutant D-fructose C4-epimerase
MWLSLDYLRKKGVYSIGSSNSYVIEASIEFAKETGDYILIEATPHQVNQFGGYSGMTPEDFKNFVMSIAKELGLEEDLIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILNVGPALTAAFRRGVFLLSNIEDEIIPERERSNIKRVILETMLRDDRYWRKYYDDSKRLELDIWYNLLDRIRYYWEYEDVKMVLNKLFENFSEGVDIKFIYQYFYDSYFDVREGLMKNDPRELIKYEIKRVLEDYSYAINL

SEQ ID NO: 186 - protein, 408 aa, Artificial Sequence
  mutant D-fructose C4-epimerase
MWLSWDYLRVYGVYSICSSNSYVIEASIEFAMETGDYILIEATPHQVNQFGGYSGMTPEDFVNFVMTIAREKGLEEDLIILGGDHLGPLPWQDEPSPTAMNYAFDLIRAFVESGYYKIHIDCSMPLSDDPQVLPYELIAERTRELFEIAEETARYYNFQPVYVVGTDVPIAGGGEEEGVTSVEDFRSAISSLAAYFNDVPNIWDRVVGFVIMLGIGFSYDRVFEYDRDSVRGILEEVWREDLFVEGHSTDYQARYALRNMVEDGVRILKVGPALTAAFRRGVFLLSNIEDEIIPERERSNILRVILETMLRDDRYWRDYYDDSDRLELDIWYNLLDRIRYYWEYEDVLMVLNWLFENFSEGVDIHFIYQYFYDSYFDVREGRMDNDPRELIKKEIKRVLEDYSYAINL

SEQ ID NO: 187 - protein, 408 aa, Artificial Sequence
  mutant D-fructose C4-epimerase
MWLSWDYLRKYGVYSICSSNSYVIEASIEFAMETGDYILIEATPHQVNQFGGYSGMTPEDFKNFVMKIARELGLEEDMIILGGDHLGPLPWQDEPSPTAMNYAFDLIRAFVESGYYKIHIDVSMPLSDDPQVLPYEKIAERTRELFEIAEETARKYNFQPVYVVGTDVPIAGGGEEEGVTSVEDFRSAISSLAAYFNDVPNIWDRVVGFVIMLGIGFSYDKVFEYDRDKVRGILEEVWREDLFVEGHSTDYQARYALRNMVEDGVRILLVGPALTAAFRRGVFLLSNIEDEIIPERERSNILRVILETMLRDDRYWRDYYDDSDRLELDIWYNLLDRIRYYWEYEDVLMVLNKLFENFSEGVDIKFIYQYFYDSYFDVREGRMDNDPRELILYEIKRVLEDYSYAINL

SEQ ID NO: 188 - protein, 408 aa, Artificial Sequence
  mutant D-fructose C4-epimerase
MWLSADYLRNQGVYSILSSNSYVIEASIEFAQEEGDYILIEATPHQVNQFGGYSGMTPEDFKNFVMTIARELGLEEDQIILGGDHLGPLPWQDEPSPTAMNRARDLIRAFVESGYRWIHIDTSMPLSDDPEVLPYEKIAERTRELFEIAEETAREYNFQPVYVVGTDVPIAGGGEEEGVTSVEDFRSAISSLKRYFNDVPNIWDRVVGFVIMLGIGFSYDKVFEYDRDRVRGILEEVSREDLFVEGHSTDYQARYALRNMVEDGVRILLVGPALTAAFRRGVFLLSNIEDEIIPERERSNIRRVILETMLRDDRYWRKYYDDSKRLELDIWYNLLDRIRYYWEYEDVKMVLNKLFENFSEGVDIRFIYQYFYDSYFDVREGRMDNDPRELIKKEIKRVLEDYSYAINL

SEQ ID NO: 189 - protein, 408 aa, Artificial Sequence
  mutant D-fructose C4-epimerase
MWLSLDYLRAKGVYSIGSSNSYVIEASIEFALEYGDYILIEATPHQVNQFGGYSGMTPEDFKNFVMKIAQELGLEEDKIILGGDHLGPLPWQDEPSPTAMNKAKDLIRAFVESGYTKIHIDCSMPLSDDPRVLPYEKIAERTRELFEIAEETAREYNFQPVYVVGTDVPIAGGGEEEGVTSVEDFRSAISSLKAYFNDVPNIWDRVVGFVIMLGIGFSYDIVFEYDRDKVRGILEEVSREDLFVEGHSTDYQARYALRNMVEDGVRILKVGPALTAAFRRGVFLLSNIEDEIIPERERSNIIRVILETMLRDDRYWRDYYDDSERLELDIWYNLLDRIRYYWEYEDVLMVLNLLFENFSEGVDIKFIYQYFYDSYFDVREGKMQNDPRELIKKEIMRVLEDYSYAINL

SEQ ID NO: 190 - protein, 408 aa, Artificial Sequence
  mutant D-fructose C4-epimerase
MWLSKDYLRNLGVYSIISSNSYVIEASIEFAMELGDYILIEATPHQVNQFGGYSGMTPEDFYNFVMTIAKETGLEEDLIILGGDHLGPLPWQDEPSPTAMNKAKDLIRAFVESGYLWIHIDASMPLSDDPEVLPYEKIAERTRELFEIAEETARNYNFQPVYVVGTDVPIAGGGEEEGVTSVEDFRSAISSLKKYFNDVPNIWDRVVGFVIMLGIGFSYDVVFEYDRDRVRGILEEVKREDLFVEGHSTDYQARYALRNMVEDGVRILIVGPALTAAFRRGVFLLSNIEDEIIPERERSNIMRVILETMLRDDRYWRKYYDDSDRLELDIWYNLLDRIRYYWEYEDVLMVLNWLFENFSEGVDIKFIYQYFYDSYFDVREGRMRNDPRELILKEIRRVLEDYSYAINL

SEQ ID NO: 191 - protein, 408 aa, Artificial Sequence
  mutant D-fructose C4-epimerase
MWLSKDYLRKQGVYSICSSNSYVIEASIEFAKEEGDYILIEATPHQVNQFGGYSGMTPEDFRNFVMKIAKELGLEEDKIILGGDHLGPLPWQDEPSPTAMNKARDLIRAFVESGYKKIHIDASMPLSDDPKVLPYEEIAERTRELFEIAEETARKYNFQPVYVVGTDVPIAGGGEEEGVTSVEDFRSAISSLEKYFNDVPNIWDRVVGFVIMLGIGFSYDQVFEYDRDRVRGILEEVKREDLFVEGHSTDYQARYALRNMVEDGVRILKVGPALTAAFRRGVFLLSNIEDEIIPERERSNIKRVILETMLRDDRYWRDYYDDSDRLELDIWYNLLDRIRYYWEYEDVRMVLNRLFENFSEGVDIRFIYQYFYDSYFDVREGKMDNDPRELIKKEIKRVLEDYSYAINL

SEQ ID NO: 192 - protein, 408 aa, Artificial Sequence
  mutant D-fructose C4-epimerase
MWLSADYLRLQGVYSICSSNSYVIEASIEFAIEKGDYILIEATPHQVNQFGGYSGMTPEDFVNFVMKIARELGLEEDLIILGGDHLGPLPWQDEPSPTAMNYARDLIRAFVESGYLKIHIDCSMPLSDDPEVLPYELIAERTRELFEIAEETAREYNFQPVYVVGTDVPIAGGGEEEGVTSVEDFRSAISSLKKYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVVMVLNLLFENFSEGVDIKFIYQYFYDSYFDVREGRMTNDPRELIRKEIKRVLEDYSYAINL

SEQ ID NO: 193 - protein, 408 aa, Artificial Sequence
  mutant D-fructose C4-epimerase
MWLSMDYLRKQGVYSISSSNSYVIEASIEFAKELGDYILIEATPHQVNQFGGYSGMTPEDFVNFVMTIARELGLEEDKIILGGDHLGPLPWQDEPSPTAMNYAQDLIRAFVESGYKKIHIDCSMPLSDDPYVLPYELIAERTRELFEIAEETARKYNFQPVYVVGTDVPIAGGGEEEGVTSVEDFRSAISSLQKYFNDVPNIWDRVVGFVIMLGIGFSYDVVFEYDRDRVRGILEEVWREDLFVEGHSTDYQARYALRNMVEDGVRILKVGPALTAAFRRGVFLLSNIEDEIIPERERSNILRVILETMLRDDRYWRDYYDDSKRLELDIWYNLLDRIRYYWEYEDVKMVLNLLFENFSEGVDISFIYQYFYDSYFDVREGKMRNDPRELILHEIIRVLEDYSYAINL

SEQ ID NO: 194 - protein, 408 aa, Artificial Sequence
  mutant D-fructose C4-epimerase
MWLSHDYLRNKGVYSICSSNSYVIEASIEFALETGDYILIEATPHQVNQFGGYSGMTPEDFKNFVMSIAQEKGLEEDLIILGGDHLGPLPWQDEPSPTAMNLARDLIRAFVESGYTKIHIDCSMPLSDDPEVLPYELIAERTRELFEIAEETARKYNFQPVYVVGTDVPIAGGGEEEGVTSVEDFRSAISSLKRYFNDVPNIWDRVVGFVIMLGIGFSYDKVFEYDRDRVRGILEEVSREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIRFIYQYFYDSYFDVREGLMKNDPRELIKKEIKRVLEDYSYAINL

SEQ ID NO: 195 - protein, 408 aa, Artificial Sequence
  mutant D-fructose C4-epimerase
MWLSFDYLRLLGVYSICSSNSYVIEASIEFAMELGDYILIEATPHQVNQFGGYSGMTPEDFVNFVMTIAREKGLEEDLIILGGDHLGPLPWQDEPSPTAMNYAQDLIRAFVESGYIKIHIDCSMPLSDDPEVLPYELIAERTRELFEIAEETARNYNFQPVYVVGTDVPIAGGGEEEGVTSVEDFRSAISSLQAYFNDVPNIWDRVVGFVIMLGIGFSYDIVFEYDRDRVRGILEEVWREDLFVEGHSTDYQARYALRNMVEDGVRILKVGPALTAAFRRGVFLLSNIEDEIIPERERSNILRVILETMLRDDRYWRDYYDDSDRLELDIWYNLLDRIRYYWEYEDVLMVLNWLFENFSEGVDISFIYQYFYDSYFDVREGRMDNDPRELIKKEIKRVLEDYSYAINL

SEQ ID NO: 196 - protein, 408 aa, Artificial Sequence
  mutant D-fructose C4-epimerase
MWLSLDYLRKVGVYSICSSNSYVIEASIEFALEMGDYILIEATPHQVNQFGGYSGMTPEDFVNFVMSIAQEKGLEEDLIILGGDHLGPLPWQDEPSPTAMNKAKDLIRAFVESGYKKIHIDCSMPLSDDPKVLPYEKIAERTRELFEIAEETARRYNFQPVYVVGTDVPIAGGGEEEGVTSVEDFRSAISSLKAYFNDVPNIWDRVVGFVIMLGIGFSYDKVFEYDRDRVRGILEEVKREDLFVEGHSTDYQARYALRNMVEDGVRILKVGPALTAAFRRGVFLLSNIEDEIIPERERSNILRVILETMLRDDRYWRKYYDDSERLELDIWYNLLDRIRYYWEYEDVLMVLNKLFENFSEGVDIRFIYQYFYDSYFDVREGKMQNDPRELIKYEIKRVLEDYSYAINL

SEQ ID NO: 197 - protein, 408 aa, Artificial Sequence
  mutant D-fructose C4-epimerase
MWLSWDYLRNQGVYSITSSNSYVIEASIEFAKETGDYILIEATPHQVNQFGGYSGMTPEDFRNFVMTIAKELGLEEDKIILGGDHLGPLPWQDEPSPTAMNRAKDLIRAFVESGYKKIHIDCSMPLSDDPQVLPYEQIAERTRELFEIAEETARHYNFQPVYVVGTDVPIAGGGEEEGVTSVEDFRSAISSLKEYFNDVPNIWDRVVGFVIMLGIGFSYDRVFEYDRDTVRGILEEVKREDLFVEGHSTDYQARYALRNMVEDGVRILKVGPALTAAFRRGVFLLSNIEDEIIPERERSNIQRVILETMLRDDRYWRDYYDDSKRLELDIWYNLLDRIRYYWEYEDVKMVLNRLFENFSEGVDIKFIYQYFYDSYFDVREGRMKNDPRELIKKEIKRVLEDYSYAINL

SEQ ID NO: 198 - protein, 408 aa, Artificial Sequence
  mutant D-fructose C4-epimerase
MWLSLDYLRKLGVYSICSSNSYVIEASIEFAIETGDYILIEATPHQVNQFGGYSGMTPEDFVNFVMSIAQELGLEEDKIILGGDHLGPLPWQDEPSPTAMNKAKDLIRAFVESGYTKIHIDCSMPLSDDPEVLPYELIAERTRELFEIAEETAREYNFQPVYVVGTDVPIAGGGEEEGVTSVEDFRSAISSLEKYFNDVPNIWDRVVGFVIMLGIGFSYDKVFEYDRDAVRGILEEVKREDLFVEGHSTDYQARYALRNMVEDGVRILKVGPALTAAFRRGVFLLSNIEDEIIPERERSNIKRVILETMLRDDRYWRKYYKDSERLELDIWYNLLDRIRYYWEYEDVLMVLNLLFENFSEGVDIKFIYQYFYDSYFDVREGLMRNDPRELILYEIKRVLEDYSYAINL

SEQ ID NO: 199 - protein, 408 aa, Artificial Sequence
  mutant D-fructose C4-epimerase
MWLSKDYLRKLGVYSICSSNSYVIEASIEFAKEKGDYILIEATPHQVNQFGGYSGMTPEDFKNFVMSIAKELGLEEDKIILGGDHLGPLPWQDEPSPTAMNKAIDLIRAFVESGYKKIHIDTSMPLSDDPRVLPYEKIAERTRELFEIAEETARKYNFQPVYVVGTDVPIAGGGEEEGVTSVEDFRSAISSLEAYFNDVPNIWDRVVGFVIMLGIGFSYDIVFEYDRDAVRGILEEVKREDLFVEGHSTDYQARYALRNMVEDGVRILKVGPALTAAFRRGVFLLSNIEDEIIPERERSNILRVILETMLRDDRYWRDYYDDSERLELDIWYNLLDRIRYYWEYEDVLMVLNLLFENFSEGVDISFIYQYFYDSYFDVREGLMKNDPRELILKEIMRVLEDYSYAINL

SEQ ID NO: 200 - protein, 408 aa, Artificial Sequence
  mutant D-fructose C4-epimerase
MWLSHDYLRKVGVYSIGSSNSYVIEASIEFAIETGDYILIEATPHQVNQFGGYSGMTPEDFKNFVMKIAQELGLEEDLIILGGDHLGPLPWQDEPSPTAMNKARDLIRAFVESGYKLIHIDCSMPLSDDPEVLPYEKIAERTRELFEIAEETAREYNFQPVYVVGTDVPIAGGGEEEGVTSVEDFRSAISSLKTYFNDVPNIWDRVVGFVIMLGIGFSYDIVFEYDRDRVRGILEEVKREDLFVEGHSTDYQARYALRNMVEDGVRILNVGPALTAAFRRGVFLLSNIEDEIIPERERSNIKRVILETMLRDDRYWRKYYDDSKRLELDIWYNLLDRIRYYWEYEDVLMVLNLLFENFSEGVDIRFIYQYFYDSYFDVREGLMKNDPRELIKYEIIRVLEDYSYAINL

SEQ ID NO: 201 - protein, 408 aa, Artificial Sequence
  mutant D-fructose C4-epimerase
MWLSFDYLRMLGVYSIISSNSYVIEASIEFAMELGDYILIEATPHQVNQFGGYSGMTPEDFVNFVMTIARELGLEEDLIILGGDHLGPLPWQDEPSPTAMNLAQDLIRAFVESGYIVIHIDTSMPLSDDPEVLPYEEIAERTRELFEIAEETARNYNFQPVYVVGTDVPIAGGGEEEGVTSVEDFRSAISSLQAYFNDVPNIWDRVVGFVIMLGIGFSYDVVFEYDRDRVRGILEEVSREDLFVEGHSTDYQARYALRNMVEDGVRILIVGPALTAAFRRGVFLLSNIEDEIIPERERSNILRVILETMLRDDRYWRDYYDDSDRLELDIWYNLLDRIRYYWEYEDVLMVLNLLFENFSEGVDISFIYQYFYDSYFDVREGRMRNDPRELILHEIMRVLEDYSYAINL

SEQ ID NO: 202 - protein, 408 aa, Artificial Sequence
  mutant D-fructose C4-epimerase
MWLSWDYLRNQGVYSIISSNSYVIEASIEFAQETGDYILIEATPHQVNQFGGYSGMTPEDFRNFVMTIARELGLEEDRIILGGDHLGPLPWQDEPSPTAMNRARDLIRAFVESGYHVIHIDVSMPLSDDPQVLPYETIAERTRELFEIAEETARHYNFQPVYVVGTDVPIAGGGEEEGVTSVEDFRSAISSLEEYFNDVPNIWDRVVGFVIMLGIGFSYDRVFEYDRDTVRGILEEVRREDLFVEGHSTDYQARYALRNMVEDGVRILVVGPALTAAFRRGVFLLSNIEDEIIPERERSNIQRVILETMLRDDRYWRDYYDDSDRLELDIWYNLLDRIRYYWEYEDVRMVLNRLFENFSEGVDIHFIYQYFYDSYFDVREGRMDNDPRELIKKEIKRVLEDYSYAINL

SEQ ID NO: 203 - protein, 408 aa, Artificial Sequence
  mutant D-fructose C4-epimerase
MWLSADYLRNQGVYSITSSNSYVIEASIEFAQEEGDYILIEATPHQVNQFGGYSGMTPEDFRNFVMTIARELGLEEDQIILGGDHLGPLPWQDEPSPTAMNRARDLIRAFVESGYRKIHIDCSMPLSDDPEVLPYEEIAERTRELFEIAEETAREYNFQPVYVVGTDVPIAGGGEEEGVTSVEDFRSAISSLETYFNDVPNIWDRVVGFVIMLGIGFSYDQVFEYDRDRVRGILEEVSREDLFVEGHSTDYQARYALRNMVEDGVRILKVGPALTAAFRRGVFLLSNIEDEIIPERERSNIQRVILETMLRDDRYWRDYYDDSDRLELDIWYNLLDRIRYYWEYEDVRMVLNRLFENFSEGVDIRFIYQYFYDSYFDVREGRMDNDPRELIKKEIKRVLEDYSYAINL

SEQ ID NO: 204 - protein, 408 aa, Artificial Sequence
  mutant D-fructose C4-epimerase
MWLSLDYLRKKGVYSIGSSNSYVIEASIEFAIEMGDYILIEATPHQVNQFGGYSGMTPEDFVNFVMKIAKELGLEEDLIILGGDHLGPLPWQDEPSPTAMNLAKDLIRAFVESGYTKIHIDTSMPLSDDPEVLPYELIAERTRELFEIAEETAREYNFQPVYVVGTDVPIAGGGEEEGVTSVEDFRSAISSLQRYFNDVPNIWDRVVGFVIMLGIGFSYDKVFEYDRDRVRGILEEVKREDLFVEGHSTDYQARYALRNMVEDGVRILNVGPALTAAFRRGVFLLSNIEDEIIPERERSNIIRVILETMLRDDRYWRDYYDDSERLELDIWYNLLDRIRYYWEYEDVLMVLNLLFENFSEGVDISFIYQYFYDSYFDVREGKMRNDPRELILYEIKRVLEDYSYAINL

SEQ ID NO: 205 - protein, 408 aa, Artificial Sequence
  mutant D-fructose C4-epimerase
MWLSFDYLRNQGVYSICSSNSYVIEASIEFAQEQGDYILIEATPHQVNQFGGYSGMTPEDFRNFVMTIAREKGLEEDQIILGGDHLGPLPWQDEPSPTAMNRAQDLIRAFVESGYQKIHIDCSMPLSDDPEVLPYETIAERTRELFEIAEETARNYNFQPVYVVGTDVPIAGGGEEEGVTSVEDFRSAISSLQSYFNDVPNIWDRVVGFVIMLGIGFSYDTVFEYDRDRVRGILEEVSREDLFVEGHSTDYQARYALRNMVEDGVRILKVGPALTAAFRRGVFLLSNIEDEIIPERERSNIQRVILETMLRDDRYWRDYYDDSDRLELDIWYNLLDRIRYYWEYEDVRMVLNRLFENFSEGVDISFIYQYFYDSYFDVREGRMENDPRELIKKEIKRVLEDYSYAINL

SEQ ID NO: 206 - protein, 408 aa, Artificial Sequence
  mutant D-fructose C4-epimerase
MWLSLDYLRNEGVYSIVSSNSYVIEASIEFAQEHGDYILIEATPHQVNQFGGYSGMTPEDFRNFVMQIARELGLEEDRIILGGDHLGPLPWQDEPSPTAMNRARDLIRAFVESGYRKIHIDCSMPLSDDPRVLPYEEIAERTRELFEIAEETAREYNFQPVYVVGTDVPIAGGGEEEGVTSVEDFRSAISSLETYFNDVPNIWDRVVGFVIMLGIGFSYDRVFEYDRDNVRGILEEVSREDLFVEGHSTDYQARYALRNMVEDGVRILKVGPALTAAFRRGVFLLSNIEDEIIPERERSNIRRVILETMLRDDRYWRDYYDDSSRLELDIWYNLLDRIRYYWEYEDVRMVLNQLFENFSEGVDIRFIYQYFYDSYFDVREGNMQNDPRELIKKEIKRVLEDYSYAINL

SEQ ID NO: 207 - protein, 408 aa, Artificial Sequence
  mutant D-fructose C4-epimerase
MWLSLDYLRNVGVYSIISSNSYVIEASIEFASEFGDYILIEATPHQVNQFGGYSGMTPEDFVNFVMQIAREIGLEEDMIILGGDHLGPLPWQDEPSPTAMNLAFDLIRAFVESGYWVIHIDASMPLSDDPRVLPYEEIAERTRELFEIAEETAREYNFQPVYVVGTDVPIAGGGEEEGVTSVEDFRSAISSLAAYFNDVPNIWDRVVGFVIMLGIGFSYDIVFEYDRDQVRGILEEVSREDLFVEGHSTDYQARYALRNMVEDGVRILVVGPALTAAFRRGVFLLSNIEDEIIPERERSNILRVILETMLRDDRYWRDYYDDSSRLELDIWYNLLDRIRYYWEYEDVLMVLNLLFENFSEGVDIRFIYQYFYDSYFDVREGNMRNDPRELILFEIFRVLEDYSYAINL

SEQ ID NO: 208 - protein, 408 aa, Artificial Sequence
  mutant D-fructose C4-epimerase
MWLSLDYLRNLGVYSICSSNSYVIEASIEFALEMGDYILIEATPHQVNQFGGYSGMTPEDFVNFVMSIAQEKGLEEDLIILGGDHLGPLPWQDEPSPTAMNYARDLIRAFVESGYTKIHIDCSMPLSDDPEVLPYELIAERTRELFEIAEETAREYNFQPVYVVGTDVPIAGGGEEEGVTSVEDFRSAISSLQRYFNDVPNIWDRVVGFVIMLGIGFSYDIVFEYDRDRVRGILEEVSREDLFVEGHSTDYQARYALRNMVEDGVRILKVGPALTAAFRRGVFLLSNIEDEIIPERERSNIIRVILETMLRDDRYWRDYYDDSERLELDIWYNLLDRIRYYWEYEDVLMVLNLLFENFSEGVDISFIYQYFYDSYFDVREGLMENDPRELIKKEIKRVLEDYSYAINL

SEQ ID NO: 209 - protein, 408 aa, Artificial Sequence
  mutant D-fructose C4-epimerase
MWLSLDYLRALGVYSICSSNSYVIEASIEFAIETGDYILIEATPHQVNQFGGYSGMTPEDFVNFVMSIAQEKGLEEDLIILGGDHLGPLPWQDEPSPTAMNYAIDLIRAFVESGYTKIHIDCSMPLSDDPEVLPYELIAERTRELFEIAEETAREYNFQPVYVVGTDVPIAGGGEEEGVTSVEDFRSAISSLEAYFNDVPNIWDRVVGFVIMLGIGFSYDIVFEYDRDAVRGILEEVSREDLFVEGHSTDYQARYALRNMVEDGVRILKVGPALTAAFRRGVFLLSNIEDEIIPERERSNILRVILETMLRDDRYWRDYYDDSERLELDIWYNLLDRIRYYWEYEDVLMVLNLLFENFSEGVDISFIYQYFYDSYFDVREGLMENDPRELIKKEIKRVLEDYSYAINL

SEQ ID NO: 210 - protein, 408 aa, Artificial Sequence
  mutant D-fructose C4-epimerase
MWLSWDYLRRRGVYSICSSNSYVIEASIEFAQEQGDYILIEATPHQVNQFGGYSGMTPEDFRNFVMTIAREKGLEEDQIILGGDHLGPLPWQDEPSPTAMNRARDLIRAFVESGYRKIHIDCSMPLSDDPQVLPYEEIAERTRELFEIAEETARDYNFQPVYVVGTDVPIAGGGEEEGVTSVEDFRSAISSLRTYFNDVPNIWDRVVGFVIMLGIGFSYDRVFEYDRDTVRGILEEVSREDLFVEGHSTDYQARYALRNMVEDGVRILKVGPALTAAFRRGVFLLSNIEDEIIPERERSNIQRVILETMLRDDRYWREYYDDSDRLELDIWYNLLDRIRYYWEYEDVRMVLNRLFENFSEGVDIRFIYQYFYDSYFDVREGRMENDPRELIKKEIKRVLEDYSYAINL

SEQ ID NO: 211 - protein, 408 aa, Artificial Sequence
  mutant D-fructose C4-epimerase
MWLSMDYLRMQGVYSISSSNSYVIEASIEFAMELGDYILIEATPHQVNQFGGYSGMTPEDFVNFVMTIARELGLEEDMIILGGDHLGPLPWQDEPSPTAMNLARDLIRAFVESGYIKIHIDCSMPLSDDPYVLPYELIAERTRELFEIAEETARNYNFQPVYVVGTDVPIAGGGEEEGVTSVEDFRSAISSLASYFNDVPNIWDRVVGFVIMLGIGFSYDIVFEYDRDRVRGILEEVSREDLFVEGHSTDYQARYALRNMVEDGVRILKVGPALTAAFRRGVFLLSNIEDEIIPERERSNILRVILETMLRDDRYWRDYYDDSDRLELDIWYNLLDRIRYYWEYEDVLMVLNWLFENFSEGVDISFIYQYFYDSYFDVREGRMRNDPRELILYEIMRVLEDYSYAINL

SEQ ID NO: 212 - protein, 408 aa, Artificial Sequence
  mutant D-fructose C4-epimerase
MWLSFDYLRLLGVYSITSSNSYVIEASIEFAMELGDYILIEATPHQVNQFGGYSGMTPEDFYNFVMQIARELGLEEDRIILGGDHLGPLPWQDEPSPTAMNYAVDLIRAFVESGYRKIHIDCSMPLSDDPLVLPYEEIAERTRELFEIAEETAREYNFQPVYVVGTDVPIAGGGEEEGVTSVEDFRSAISSLEAYFNDVPNIWDRVVGFVIMLGIGFSYDVVFEYDRDAVRGILEEVSREDLFVEGHSTDYQARYALRNMVEDGVRILKVGPALTAAFRRGVFLLSNIEDEIIPERERSNIMRVILETMLRDDRYWRDYYDDSSRLELDIWYNLLDRIRYYWEYEDVRMVLNLLFENFSEGVDISFIYQYFYDSYFDVREGRMRNDPRELILYEIIRVLEDYSYAINL

SEQ ID NO: 213 - protein, 408 aa, Artificial Sequence
  mutant D-fructose C4-epimerase
MWLSLDYLRNQGVYSISSSNSYVIEASIEFAQERGDYILIEATPHQVNQFGGYSGMTPEDFRNFVMTIARELGLEEDRIILGGDHLGPLPWQDEPSPTAMNRARDLIRAFVESGYQVIHIDTSMPLSDDPEVLPYEEIAERTRELFEIAEETAREYNFQPVYVVGTDVPIAGGGEEEGVTSVEDFRSAISSLESYFNDVPNIWDRVVGFVIMLGIGFSYDRVFEYDRDSVRGILEEVSREDLFVEGHSTDYQARYALRNMVEDGVRILVVGPALTAAFRRGVFLLSNIEDEIIPERERSNIQRVILETMLRDDRYWRDYYDDSSRLELDIWYNLLDRIRYYWEYEDVRMVLNRLFENFSEGVDISFIYQYFYDSYFDVREGRMQNDPRELIKKEIKRVLEDYSYAINL

SEQ ID NO: 214 - protein, 408 aa, Artificial Sequence
  mutant D-fructose C4-epimerase
MWLSLDYLRAVGVYSIGSSNSYVIEASIEFALEYGDYILIEATPHQVNQFGGYSGMTPEDFVNFVMRIAQELGLEEDRIILGGDHLGPLPWQDEPSPTAMNLARDLIRAFVESGYTKIHIDCSMPLSDDPRVLPYEIIAERTRELFEIAEETAREYNFQPVYVVGTDVPIAGGGEEEGVTSVEDFRSAISSLEAYFNDVPNIWDRVVGFVIMLGIGFSYDIVFEYDRDNVRGILEEVSREDLFVEGHSTDYQARYALRNMVEDGVRILKVGPALTAAFRRGVFLLSNIEDEIIPERERSNILRVILETMLRDDRYWRDYYDDSERLELDIWYNLLDRIRYYWEYEDVLMVLNLLFENFSEGVDIRFIYQYFYDSYFDVREGLMRNDPRELILYEIIRVLEDYSYAINL

SEQ ID NO: 215 - protein, 408 aa, Artificial Sequence
  mutant D-fructose C4-epimerase
MWLSADYLRNVGVYSIGSSNSYVIEASIEFAIETGDYILIEATPHQVNQFGGYSGMTPEDFVNFVMSIAQELGLEEDLIILGGDHLGPLPWQDEPSPTAMNYARDLIRAFVESGYTKIHIDCSMPLSDDPEVLPYELIAERTRELFEIAEETAREYNFQPVYVVGTDVPIAGGGEEEGVTSVEDFRSAISSLERYFNDVPNIWDRVVGFVIMLGIGFSYDIVFEYDRDRVRGILEEVSREDLFVEGHSTDYQARYALRNMVEDGVRILKVGPALTAAFRRGVFLLSNIEDEIIPERERSNIIRVILETMLRDDRYWRDYYDDSERLELDIWYNLLDRIRYYWEYEDVLMVLNLLFENFSEGVDIRFIYQYFYDSYFDVREGLMTNDPRELILYEIIRVLEDYSYAINL

SEQ ID NO: 216 - protein, 408 aa, Artificial Sequence
  mutant D-fructose C4-epimerase
MWLSADYLRNVGVYSIGSSNSYVIEASIEFAIEMGDYILIEATPHQVNQFGGYSGMTPEDFVNFVMSIAQELGLEEDRIILGGDHLGPLPWQDEPSPTAMNYAIDLIRAFVESGYSLIHIDTSMPLSDDPEVLPYELIAERTRELFEIAEETAREYNFQPVYVVGTDVPIAGGGEEEGVTSVEDFRSAISSLEAYFNDVPNIWDRVVGFVIMLGIGFSYDIVFEYDRDAVRGILEEVSREDLFVEGHSTDYQARYALRNMVEDGVRILNVGPALTAAFRRGVFLLSNIEDEIIPERERSNILRVILETMLRDDRYWRDYYDDSERLELDIWYNLLDRIRYYWEYEDVRMVLNLLFENFSEGVDISFIYQYFYDSYFDVREGLMRNDPRELILYEIIRVLEDYSYAINL

SEQ ID NO: 217 - protein, 408 aa, Artificial Sequence
  mutant D-fructose C4-epimerase
MWLSLDYLRRVGVYSIGSSNSYVIEASIEFAIEMGDYILIEATPHQVNQFGGYSGMTPEDFVNFVMSIAQELGLEEDLIILGGDHLGPLPWQDEPSPTAMNYARDLIRAFVESGYTLIHIDTSMPLSDDPRVLPYELIAERTRELFEIAEETARRYNFQPVYVVGTDVPIAGGGEEEGVTSVEDFRSAISSLIAYFNDVPNIWDRVVGFVIMLGIGFSYDIVFEYDRDRVRGILEEVSREDLFVEGHSTDYQARYALRNMVEDGVRILNVGPALTAAFRRGVFLLSNIEDEIIPERERSNILRVILETMLRDDRYWRDYYDDSERLELDIWYNLLDRIRYYWEYEDVLMVLNLLFENFSEGVDIRFIYQYFYDSYFDVREGLMRNDPRELILYEIIRVLEDYSYAINL

SEQ ID NO: 218 - protein, 408 aa, Artificial Sequence
  mutant D-fructose C4-epimerase
MWLSRDYLRRRGVYSICSSNSYVIEASIEFARERGDYILIEATPHQVNQFGGYSGMTPEDFRNFVMRIAREKGLEEDRIILGGDHLGPLPWQDEPSPTAMNRARDLIRAFVESGYRKIHIDCSMPLSDDPRVLPYERIAERTRELFEIAEETARRYNFQPVYVVGTDVPIAGGGEEEGVTSVEDFRSAISSLRRYFNDVPNIWDRVVGFVIMLGIGFSYDRVFEYDRDRVRGILEEVRREDLFVEGHSTDYQARYALRNMVEDGVRILKVGPALTAAFRRGVFLLSNIEDEIIPERERSNIRRVILETMLRDDRYWRRYYRDSRRLELDIWYNLLDRIRYYWEYEDVRMVLNRLFENFSEGVDIRFIYQYFYDSYFDVREGRMRNDPRELIKKEIKRVLEDYSYAINL

SEQ ID NO: 219 - protein, 408 aa, Artificial Sequence
  mutant D-fructose C4-epimerase
MWLSRDYLRRRGVYSIRSSNSYVIEASIEFARERGDYILIEATPHQVNQFGGYSGMTPEDFRNFVMRIARERGLEEDRIILGGDHLGPLPWQDEPSPTAMNRARDLIRAFVESGYRKIHIDCSMPLSDDPRVLPYERIAERTRELFEIAEETARRYNFQPVYVVGTDVPIAGGGEEEGVTSVEDFRSAISSLRRYFNDVPNIWDRVVGFVIMLGIGFSYDRVFEYDRDRVRGILEEVRREDLFVEGHSTDYQARYALRNMVEDGVRILKVGPALTAAFRRGVFLLSNIEDEIIPERERSNIRRVILETMLRDDRYWRRYYRDSRRLELDIWYNLLDRIRYYWEYEDVRMVLNRLFENFSEGVDIRFIYQYFYDSYFDVREGRMRNDPRELIRREIRRVLEDYSYAINL

SEQ ID NO: 220 - protein, 408 aa, Artificial Sequence
  mutant D-fructose C4-epimerase
MWLSRDYLRRRGVYSIRSSNSYVIEASIEFARERGDYILIEATPHQVNQFGGYSGMTPEDFRNFVMRIARERGLEEDRIILGGDHLGPLPWQDEPSPTAMNRARDLIRAFVESGYRRIHIDRSMPLSDDPRVLPYERIAERTRELFEIAEETARRYNFQPVYVVGTDVPIAGGGEEEGVTSVEDFRSAISSLRRYFNDVPNIWDRVVGFVIMLGIGFSYDRVFEYDRDRVRGILEEVRREDLFVEGHSTDYQARYALRNMVEDGVRILRVGPALTAAFRRGVFLLSNIEDEIIPERERSNIRRVILETMLRDDRYWRRYYRDSRRLELDIWYNLLDRIRYYWEYEDVRMVLNRLFENFSEGVDIRFIYQYFYDSYFDVREGRMRNDPRELIRREIRRVLEDYSYAINL

SEQ ID NO: 221 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNYAKDLIRAFVESGYKKIHIDCSMPLSDDPQVLPYEKIAERTRELFEIAEETARKYNFQPVYVVGTDVPIAGGGEEEGVTSVEDFRSAISSLKKYFNDVPNIWDRVVGFVIMLGIGFSYDRVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 222 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNLAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDIVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 223 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNRAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDTVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 224 - protein, 408 aa, Artificial Sequence
  mutant D-fructose C4-epimerase
MWLSKDYLRKKGVYSITSSNSYVIEASIEFAKEKGDYILIEATPHQVNQFGGYSGMTPEDFKNFVMKIAKEKGLEEDKIILGGDHLGPLPWQDEPSPTAMNRAKDLIRAFVESGYKKIHIDCSMPLSDDPQVLPYEKIAERTRELFEIAEETARKYNFQPVYVVGTDVPIAGGGEEEGVTSVEDFRSAISSLKKYFNDVPNIWDRVVGFVIMLGIGFSYDRVFEYDRDKVRGILEEVKREDLFVEGHSTDYQARYALRNMVEDGVRILVVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 225 - protein, 408 aa, Artificial Sequence
  mutant D-fructose C4-epimerase
MWLSKDYLRKKGVYSILSSNSYVIEASIEFAKEKGDYILIEATPHQVNQFGGYSGMTPEDFKNFVMKIAKEKGLEEDKIILGGDHLGPLPWQDEPSPTAMNLAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDRVFEYDRDKVRGILEEVKREDLFVEGHSTDYQARYALRNMVEDGVRILLVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 226 - protein, 408 aa, Artificial Sequence
  mutant D-fructose C4-epimerase
MWLSKDYLRKKGVYSIGSSNSYVIEASIEFAKEKGDYILIEATPHQVNQFGGYSGMTPEDFKNFVMKIAKEKGLEEDKIILGGDHLGPLPWQDEPSPTAMNYAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDIVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 227 - protein, 408 aa, Artificial Sequence
  mutant D-fructose C4-epimerase
MWLSKDYLRKKGVYSISSSNSYVIEASIEFAKEKGDYILIEATPHQVNQFGGYSGMTPEDFKNFVMKIAKEKGLEEDKIILGGDHLGPLPWQDEPSPTAMNLAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDVVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 228 - protein, 408 aa, Artificial Sequence
  mutant D-fructose C4-epimerase
MWLSKDYLRKKGVYSITSSNSYVIEASIEFAKEKGDYILIEATPHQVNQFGGYSGMTPEDFKNFVMKIAKEKGLEEDKIILGGDHLGPLPWQDEPSPTAMNRAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDQVFEYDRDKVRGILEEVKREDLFVEGHSTDYQARYALRNMVEDGVRILKVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 229 - protein, 408 aa, Artificial Sequence
  mutant D-fructose C4-epimerase
MWLSKDYLRKKGVYSIGSSNSYVIEASIEFAKEKGDYILIEATPHQVNQFGGYSGMTPEDFKNFVMKIAKEKGLEEDKIILGGDHLGPLPWQDEPSPTAMNLAKDLIRAFVESGYKKIHIDCSMPLSDDPEVLPYEKIAERTRELFEIAEETARKYNFQPVYVVGTDVPIAGGGEEEGVTSVEDFRSAISSLKKYFNDVPNIWDRVVGFVIMLGIGFSYDQVFEYDRDKVRGILEEVKREDLFVEGHSTDYQARYALRNMVEDGVRILNVGPALTAAFRRGVFLLSNIEDEIIPERERSNIKRVILETMLRDDRYWRDYYDDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 230 - protein, 408 aa, Artificial Sequence
  mutant D-fructose C4-epimerase
MWLSKDYLRKKGVYSIGSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILNVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 231 - protein, 408 aa, Artificial Sequence
  mutant D-fructose C4-epimerase
MWLSKDYLRKKGVYSICSSNSYVIEASIEFAKEKGDYILIEATPHQVNQFGGFSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTAVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRAYWEYEDVKMVLNKLFENFSEGVDIKFIYQYFYDSYFDVREGKMKNDPRELIKKEIKRVLEDYSYAINL

SEQ ID NO: 232 - protein, 408 aa, Artificial Sequence
  mutant D-fructose C4-epimerase
MWERRENGQREGVYSICSSNEYVIRASIRFARERHDRILIEATPHQVNHRGGYSGMTPEDFRREVERIAREEGLDERRIILGGDHLGPLPWQDRPRPEAMNEARQLIRAFVESGYDKIHIDCSMPLSDEPEVLDYREIAEQTRQLFEEAERRRTERDRQPVYVVGTDVPIAGGGEEEGVTSVEDFRRAIEYLERYFPDVPNIWDRVVGFVIMLGIGFTRDRVFQYDREEVRRILEEVRRTDLFVEGHSTDYQARYALRNMVEDGVRILKVGPALTAAFRRGVFLLSEIEREIIPERRRQDIRRVILETMLRDDRYWRDYYDTSDEHRRDIEYNLLDRIRYYWDYPDVREVLRRLFENFSEGVDPEFIREYFYRSYERVRDGEMRNDPRELIEEEIRQVLEDYRYAIDR

SEQ ID NO: 233 - protein, 408 aa, Artificial Sequence
  mutant D-fructose C4-epimerase
MWERRRHGEERGVYSICSSNEYVIRASIEFARQRGRDILIEATPHQVNQHGGYSGMTPEDFKRFVMEIAREEGLDERRIRLGGDHLGPLPWQDRPEPEAMQEARELIRAFVESGYRKIHIDCSMPLSDDPKVLPQEEIARRTRELFEVAERRRQEYEEEPVYVVGTDVPIAGGGEEEGVTSVEDFRRAIEHLEEYFPDVPNIRDRVVGFVIMLGIGFTRDRVFQYDRDKVRGILEEVKRTDLFVEGHSTDYQARYALRNMVRDGVRILKVGPALTAAFRRGVFLLSEIEREIIPERRRQDIRRVILETMLRDDRYWRDYYETSDQLRLDIEYNLLDRIRYYWDYPDVREVLRRLFENFSEGVDERRIYEYFYESYQDVRDGRMRNDPRELIREEIRRVLEDYEYAIDG

SEQ ID NO: 234 - protein, 408 aa, Artificial Sequence
  mutant D-fructose C4-epimerase
MWLRKQNNEPVGVYSICSSNPYVIEASIEFAMELSDYILIEATPHQVNFQGGYSGMTPEDFRRFVMEIARSKGLDERMIILGGDHLGPLPWQDLPEPQAMEYARQLIRAFVESGYQKIHIDCSMPLSDDPETLDWRRIAERTRELFEIAERTSPPVPNTIVYVVGTDVPIAGGGEEEGVTSVEDFRSAIETLERYFEDVPNIRDRVVGFVIMLGINFSYRTVFEYDRDQVEEILREVERTDLFVEGHSTDYQARYALENMVRDGVRILKVGPALTAAFRRGVFLLSQIEREIIPERHRSDIRRVILETMLRDPRYWRDYYDDSPQLEEDIWYNLLDRIRYYWEYPDVEEVLRQLFENFSEGVDERFIYQYFYDSYFDVRNGNMDTDPRELIKKEIKRVLEDYAYAIQL

SEQ ID NO: 235 - protein, 408 aa, Artificial Sequence
  mutant D-fructose C4-epimerase
MWLRQRNGEPVGVYSICSSNEYVIEASIEFAQESNTYILIEATPHQVNHRGGYSGMTPRDFRRFVEEIARSKGLDERRIILGGDHLGPLPWQDRPEPEAMQEARELIRAFVESGYRKIHIDCSMPLSDQSETLDYREIARQTRELFREAEETATTDPNETVYVVGTDVPIAGGGEEEGRTSVEDFRSAIEELERYFRDVDNIRDRVVGFVIMLGITFSRDRVFEYDRDQVREILEEVRRTDLFVEGHSTDYQARYALRNMVEDGVRILKVGPALTAAFRRGVFLLSRIEREIIPERHRSNIEEVILRTMLRDDRYWRNYYEDSDQLREDIWYNLLDRIRYYWDYPDVREVLRQLFENFSEGVDERFIYRYFYDSYFDVRDGRMQNDPRELIKKEIKRVLEDYRYAIEL

SEQ ID NO: 236 - protein, 408 aa, Artificial Sequence
  mutant D-fructose C4-epimerase
MWLRHQNNEPVGVYSICSSNPYVIEASIEFAQESNSYILIEATPHQVNQHGGYSGMTPEDFKEFVMRIARSKGLDERRIILGGDHLGPLPWQDQPEPEAMQEARELIRAFVESGYLKIHIDCSMPLSDQPETLDYREIARHTRELFQIAEETSPPRPNQTVYVVGTDVPIAGGGEEEGVTSVEDFRSAIEALERYFEDVPNIRDRVVGFVIMLGINFSYREVFEYDRDQVEEILREVERTDLFVEGHSTDYQARYALRNMVEDGVRILKVGPALTAAFRRGVFLLSQIEREIIPERHRSNIQEVILQTMLRDPRYWRDYYDDSPQLEEDIWYNLLDRIRYYWDYPDVEEVLRQLFENFSEGVDERFIYRYFYDSYFDVREGKMKNDPRELIKKEIKRVLEDYRYAIEL

SEQ ID NO: 237 - protein, 408 aa, Artificial Sequence
  mutant D-fructose C4-epimerase
MWLRQRNGQRWGVYSICSSNEYVIRASIRFAKQRDQYILIEATPHQVNHRGGYSGMTPRDFRRFVEQIAREEGLEPRRIILGGDHLGPLPWQDRPEPEAMEEARELIRAFVESGYEKIHIDCSMPLSDDSETLDYREIARRTRELFREAEETATTDPNRTVYVVGTDVPIAGGGEEEGRTSVEDFRSAIEYLRQYFQDVPNIWDRVVGFVIMLGITFSRRRVFEYDRDQVREILEEVRRTDLFVEGHSTDYQARYALRNMVEDGVRILKVGPALTAAFRRGVFLLSEIEREIIPERRRSNIREVILRTMLRDDRYWRKYYEDSDELEEDIEYNLLDRIRYYWDYPDVRRVLEELFRNFSEGVDERFIYRYFYDSYFHVRDGRMRNDPRELIEQEIREVLEDYRYAIEL

SEQ ID NO: 238 - protein, 408 aa, Artificial Sequence
  mutant D-fructose C4-epimerase
MWLERHYNLERGVYSICSSNPYVIEASIEFARNRHLPILIEATPHQVNIFGGYSGMTPTDFRDFVMDIARRKGLDERDIILGGDHLGPLPWQDLPAPEAMDRARQLIRAFVESGYRKIHIDCSMPLSDQPEVLHWDEIAELTRELFRVAEEVAQDYPNLLVYVVGTDVPIAGGGEEEGITSVEDFRSAIEALRRYFNDVLNIWDRVVGFVIMLGIRFSYDRVFMYDRDRVREILEEVRRVPLFVEGHSTDYQARYALRNMVQDGVRILKVGPALTAAFRRGVFLLSLIEDEIIPERRRSEIRRVILETMLRDPRYWRDYYDDSDRLYWDILYNLLDRIRYYWDYPDVRTVLERLFRNFSEPVPLEHIRDYFYDSYEDVRDGRMENDPRELIKKEIKRVLEDYAYAIDT

SEQ ID NO: 239 - protein, 408 aa, Artificial Sequence
  mutant D-fructose C4-epimerase
MWERREYGQREGVYSICSSNRYVIEASIEFARTRHDRILIEATPHQVNHRGGYSGMTPEDFKREVMRIAREKGLDERRIILGGDHLGPLPWQDRPRPEAMNEARQLIRAFVESGYRKIHIDCSMPLSDEPKVLPWEEIAEQTRQLFEEAERRRTEYNFQPEYVVGTDVPIAGGGEEEGVTSVEDFRRAIEELKRYFPDVPNIRDRVVGFVIMLGIGFSRDKVFEYDRDKVRGILEEVKREDLFVEGHSTDYQARYALRNMVEDGVRILKVGPALTAAFRRGVFLLSNIEDEQIPERERQNIKRVILETMLRDDRYWRDYYDTSDRHREDIWYNLLDRIRYYWEYEDVKRVLEELFRNFSEGVDPEFIRRYFYDSYEDVRNGRMRNDPRELIKKEIKRVLEDYRYAIER

SEQ ID NO: 240 - protein, 408 aa, Artificial Sequence
  mutant D-fructose C4-epimerase
MWLRHQYGQEEGVYSICSSNEYVIRASIRFAQRKHERILIEATPHQVNHRGGYSGMTPRDFREEVMRIAREEGLDERQIILGGDHLGPLPWQDRPRPEAMNEARQLIRAFVESGYRKIHIDCSMPLSDEPKVLPYEEIARQTRELFEEAERRARKYNFQPEYVVGTDVPIAGGGEEEGVTSVEDFRRAIEELKRYFPDVPNIRDRVVGFVIMLGIGFSRDKVFEYDRDQVREILEEVRREDLFVEGHSTDYQARYALRNMVQDGVRILKVGPALTAAFRRGVFLLSEIEREQIPERERSNIREVILRTMLRDDRYWRKYYDTSDRHREDIEYNLLDRIRYYWDYPDVREVLRKLFENFSEGVDIRFIYRYFYRSYEDVREGRMQNDPRELIHREIEEVLQDYRYAIER

SEQ ID NO: 241 - protein, 408 aa, Artificial Sequence
  mutant D-fructose C4-epimerase
MWEEHRHGQEFGVYSICSSNEYVIEASIEFAKEQGTYILIEATPHQVNHRGGYSGMTPEDFRRFVEEIARRKGLDERMIILGGDHLGPLPWQDQPRPTAMNEARELIRAFVESGYTKIHIDCSMPLSDDPEVLPDEEIARRTRELFEEAERHRQQYPTEPVYVVGTDVPIAGGGEEEGVTSVEDFRRAIEALQRYFPDVENIRDRVVGFVIMLGIGFTRDRVFQYDRDRVREILEEVRRTDLFVEGHSTDYQARYALRNMVRDGVRILKVGPALTAAFRRGVFLLSEIEREIIPERRRQDIRRVILETMLRDDRYWRDYYETSKQLEEDIEYNLLDRIRYYWDYPDVRRVLNELFRNFSEGVDERFIYQYFYDSYQDVRDGRMTNDPRELIKKEIKRVLEDYSYAIHR

SEQ ID NO: 242 - protein, 408 aa, Artificial Sequence
  mutant D-fructose C4-epimerase
MWLRKQNNEKRGVYSICSSNPYVIEASIEFARERNDYILIEATPHQVNQFGGYSGMTPEDFKRFVMEIARSKGLDERRIILGGDHLGPLPWQDLPSPEAMRRAEELIRAFVESGYRKIHIDCSMPLSDDPETLPWEKIAERTRRLFEIAERTAPEVPNEMVYVVGTDVPIAGGGEEEGVTSVEDFRSAISTLERYFEDVPNIRDRVVGFVIMLGIGFSYDKVFEYDRDKVRGILEEVKRTDLFVEGHSTDYQARYALRNMVEDGVRILKVGPALTAAFRRGVFLLSQIEREIIPERHRSDIRRVILETMLRDDRYWRKYYDDSDQLELDIWYNLLDRIRYYWEYEDVKRVLEELFRNFSEGVDERFIYQYFYDSYFDVRNGRMKNDPRELIKKEIKRVLEDYAYAIQL

SEQ ID NO: 243 - protein, 408 aa, Artificial Sequence
  mutant D-fructose C4-epimerase
MWLEKQNNQDRGVYSICSSNPYVIEASIEFARERDQYILIEATPHQVNQFGGYSGMTPEDFKRFVMEIARQKGLEEDMIILGGDHLGPLPWQDEPEPTAMEKARQLIRAFVESGYRKIHIDCSMPLSDQPETLDWREIARLTRELFEIAERTAPEVPNEMVYVVGTDVPIAGGGEEEGVTSVEDFRSAIETLKRYFSDVPNIADRVVGFVIMLGINFSYREVFEYDRDRVREILEEVKREDLFVEGHSTDYQARYALENMVRDGVRILKVGPALTAAFRRGVFLLSQIEREIIPERHRSNIERVILETMLRDDRYWRKYYDDSDQLEEDIWYNLLDRIRYYWDYEDVRRVLEELFRNFSEGVDERFIYQYFYDSYFDVRNGRMENDPRELIKKEIKRVLEDYAYAIEL

SEQ ID NO: 244 - protein, 408 aa, Artificial Sequence
  mutant D-fructose C4-epimerase
MWLRHEYGQREGVYSICSSNRYVIEASIEFAQTRHERILIEATPHQVNHRGGYSGMTPEDFKREVMRIAREKGLDEDKIILGGDHLGPLPWQDRPSPEAMEEAKELIRAFVESGYRKIHIDCSMPLSDEPEVLPYEKIAERTRELFEIAEETRTQYNFQPEYVVGTDVPIAGGGEEEGVTSVEDFRSAIEQLQRHFPDVENIRDRVVGFVIMLGIGFSRDKVFEYDRDQVREILEEVRRTDLFVEGHSTDYQARYALRNMVEDGVRILKVGPALTAAFRRGVFLLSEIEREIIPERRRQDIRRVILETMLRDDRYWRNYYDTSDEHRRDIEYNLLDRIRYYWNYPDVEEVLRRLFENFSEGVDPEFIRRYFYDSYEDVREGRMQNDPRELIKKEIKRVLEDYRYAIER

SEQ ID NO: 245 - protein, 408 aa, Artificial Sequence
  mutant D-fructose C4-epimerase
MWLEHHYGRPQGVYSICSSNEYVIRASIRFAQRQHHPILIEATPHQVNHRGGYSGMTPEDFRRFVEQIAREEGLEERMIILGGDHLGPLPWQDRPEPEAMNEARELIRAFVESGYWKIHIDCSMPLSDDSETLDYRRIAERTRELFREAEETARGYPFQPVYVVGTDVPIAGGGEEEGRTSVEDFRSAIEYLRQYFNDVRNIWDRVVGFVIMLGIRFSRDRVFEYDRDQVREILEEVRRHDLFVEGHSTDYQARYALRNMVEDGVRILKVGPALTAAFRRGVFLLSEIEREIIPERRRSDIRRVILETMLRDDRYWRDYYETSEQLERDIWYNLLDRIRYYWDYPDVREVLRRLFENFSEPVDIRFIYRYFYDSYEDVRDGRMQPDPRELILHEIEEVLRDYSYAIND

SEQ ID NO: 246 - protein, 408 aa, Artificial Sequence
  mutant D-fructose C4-epimerase
MWLRHHYNEPQGVYSICSSNPYVIEASIEFAQHRHEPILIEATPHQVNQHGGYSGMTPEDFRRFVMEIARRKGLDERLIILGGDHLGPLPWQDQPEPEAMNQAQELIRAFVESGYLKIHIDCSMPLSDQPEVLPYEEIAEHTRELFRVAEETAQDYPFQLVYVVGTDVPIAGGGEEEGVTSVEDFRSAIEHLRQYFRDVPNIWDRVVGFVIMLGIRFSYDRVFEYDRDQVREILEEVRREPLFVEGHSTDYQARYALRNMVEDGVRILKVGPALTAAFRRGVFLLSQIEDEIIPERERSNIRQVILETMLRDPRYWRDYYDDSDRLEEDIWYNLLDRIRYYWDYEDVRRVLERLFRNFSEPVDIRFIYRYFYDSYEDVRDGRMEPDPRELIKKEIKRVLEDYRYAIDT

SEQ ID NO: 247 - protein, 408 aa, Artificial Sequence
  mutant D-fructose C4-epimerase
MWEEKRHGRERGVYSICSSNEYVIEASIEFAIEMGYYILIEATPHQVNWSGGYSGWTPEDFRRFVEEIARRKGLDPDMIILGGDHLGPLPWQDLPEPRAMEYARELIRAFVESGYLKIHIDCSMPLSDRPDELPREEIARWTRDLFEIAERYRQTFRTEPVYVVGTDVPIAGGGEEEGVTSVEDFRSAIEYLQRYFPDVPNIRDRVVGFVIMLGIGFTRRRVFQYDRDRVREILEEVRRTDLFVEGHSTDYQARYALRNMVRDGVRILKVGPALTAAFRRGVFLLSEIEREIIPERRRQNIREVILRTMLRDDRYWRDYYETSDRLEEDIEYNLLDRIRYYWDYPDVREVLRRLFENFSEGVDPRFIYRYFYDSYEDVRRGQMTNDPRELIKKEIKRVLEDYAYAIWD

SEQ ID NO: 248 - protein, 408 aa, Artificial Sequence
  mutant D-fructose C4-epimerase
MWLRHQNNEPVGVYSICSSNPYVIEASIRAAQQTNTYILIEATPHQVNQHGGYSGMTPEDFREFVMRIARSTGLDERRIILGGDHLGPLPWQDQPEPEAMEQARQLIRAFVESGYLKIHIDCSMPLSDDPETLDYRRIAERTRELFEIAERTSPPRPNQTVYVVGTDVPIAGGGEEEGVTSVEDFRSAIEHLRQYFSDVPNIHDRVVGFVIMLGINFSYRTVFEYDRDQVEEILREVRRTDLFVEGHSTDYQARYALENMVRDGVRILKVGPALTAAFRRGVFLLSQIEREIIPERHRSDIRRVILETMLRDPRYWRDYYDDSPQLEEDIWYNLLDRIRYYWDYEDVRRVLEQLFRNFSEGVDERFIYQYFYDSYFDVRNGRMSNDPRELILAEIEHVLRDYWYAIEL

SEQ ID NO: 249 - protein, 408 aa, Artificial Sequence
  mutant D-fructose C4-epimerase
MWLRKQNNEPVGVYSICSSNPYVIEASIEFAMELDLYILIEATPHQVNQFGGYSGMTPEDFREFVMRIARSKGLDERMIILGGDHLGPLPWQDEPSPTAMNKARELIRAFVESGYQKIHIDCSMPLSDDPETLPWEKIAERTRELFEIAERTAPPVPNTMVYVVGTDVPIAGGGEEEGVTSVEDFRSAISTLRRYFSDVPNIARRVVGFVIMLGINFSYRTVFEYDRDKVRGILEEVRRTDLFVEGHSTDYQARYALRNMVEDGVRILKVGPALTAAFRRGVFLLSNIEDEIIPERHRSNIKRVILETMLRDDRYWRDYYDDSPQLEEDIWYNLLDRIRYYWEYPDVREVLRLLFENFSEGVDERFIYQYFYDSYFDVREGKMQNDPRELIKKEIKRVLEDYSYAIRL

SEQ ID NO: 250 - protein, 408 aa, Artificial Sequence
  mutant D-fructose C4-epimerase
MWERKQNGERHGVYSICSSNEYVIEASIEFAITRHERILIEATPHQVNQFGGYSGMTPEDFRREVERIAREKGLDERLIILGGDHLGPLPWQDEPSPTAMNKAEELIRAFVESGYYKIHIDCSMPLSDLPEVLDWREIAERTRRLFEIAEERRTQQNTEFVYVVGTDVPIAGGGEEEGITSVEDFRSAIEWLRRYFPDVPNIRDRVVGFVIMLGIGFSRDKVFEYDRDAVRGILEEVRREDLFVEGHSTDYQARYALRNMVEDGVRILKVGPALTAAFRRGVFLLSEIEREEIPERRRQDIRRVILETMLRDDRWWRNYYDTSDRHREDIEYNLLDRIRYYWDYPDVREVLERLFRNFSEGVDIRRIYEYFYDSYEDVREGRMRNDPRELIKKEIKRVLEDYRYAIEN

SEQ ID NO: 251 - protein, 408 aa, Artificial Sequence
  mutant D-fructose C4-epimerase
MWLRKQNNEPVGVYSICSSNPYVIEASIEFAKELNDYILIEATPHQVNQFGGYSGMTPEDFRRFVMEIARSKGLDERMIILGGDHLGPLPWQDLPEPQAMHYAEQLIRAFVESGYRKIHIDCSMPLSDDPETLDWRRIAERTRRLFEIAERTAPPVPNEMVYVVGTDVPIAGGGEEEGVTSVEDFRSAISTLRRYFSDVPNIARRVVGFVIMLGINFSYDRVFQYDRDQVREILEEVRRTDLFVEGHSTDYQARYALENMVRDGVRILKVGPALTAAFRRGVFLLSNIEDEIIPERHRSNIKRVILETMLRDDRYWRDYYKDSKRLELDIWYNLLDRIRYYWEYEDVKRVLELLFRNFSEGVDERFIYQYFYDSYFDVRNGNMSNDPRDLIRKEIALVLEDYAYAIQL

SEQ ID NO: 252 - protein, 408 aa, Artificial Sequence
  mutant D-fructose C4-epimerase
MWLRKQYNEPVGVYSICSSNPYVIEASIEFAMELNTYILIEATPHQVNQFGGYSGMTPEDFKEFVMRIARSKGLDERRIILGGDHLGPLPWQDLPSPQAMEYAKELIRAFVESGYQKIHIDCSMPLSDDPETLPYEKIAERTRELFEIAEETAPPVPNTMVYVVGTDVPIAGGGEEEGVTSVEDFRSAIESLRKYFSDVPNIWDRVVGFVIMLGIGFSYDKVFEYDRDQVREILEEVKRTDLFVEGHSTDYQARYALENMVRDGVRILKVGPALTAAFRRGVFLLSQIEREIIPERHRSDIRRVILETMLRDPRYWRDYYDDSPQLELDIWYNLLDRIRYYWDYPDVRRVLEALFRNFSEGVDIKFIYQYFYDSYFDVREGKMDTDPRELIKKEIKLVLEDYSYAINL

SEQ ID NO: 253 - protein, 408 aa, Artificial Sequence
  mutant D-fructose C4-epimerase
MWERRQNGQKEGVYSICSSNEYVIRASIEFAKERHSRILIEATPHQVNHRGGYSGMTPEDFKREVMRIAREKGLDERRIILGGDHLGPLPWQDRPSPEAMNEARQLIRAFVESGYRKIHIDCSMPLSDDPKVLPYEKIAERTRELFREAEERARKYNFQPEYVVGTDVPIAGGGEEEGVTSVEDFRSAIEYLKRYFPDVPNIRDRVVGFVIMLGIGFSYDKVFEYDRDKVRGILEEVRREDLFVEGHSTDYQARYALRNMVEDGVRILKVGPALTAAFRRGVFLLSNIEDEQIPERERSNIKRVILETMLRDDRYWRDYYKDSKRLELDIWYNLLDRIRYYWNYPDVREVLRKLFENFSEGVDPEFIRRYFYDSYEDVRDGRMDNDPRRLIEKEIKRVLEDYSYAIHR

SEQ ID NO: 254 - protein, 408 aa, Artificial Sequence
  mutant D-fructose C4-epimerase
MWLEREYGRKKGVYSICSSNEYVIEASIEFAKTRGDRILIEATPHQVNHRGGYSGMTPRDFREEVMRIAREKGLEEDRIILGGDHLGPLPWQDRPRPEAMEEAKELIRAFVESGYKKIHIDCSMPLSDEPKVLPYEEIAEQTRELFEIAEETARKYNFQPVYVVGTDVPIAGGGEEEGVTSVEDFRSAIESLERYFPDVENIRDRVVGFVIMLGIGFTRDRVFQYDRDKVRGILEEVKRTDLFVEGHSTDYQARYALRNMVEDGVRILKVGPALTAAFRRGVFLLSEIEREQIPERERSDIRRVILETMLRDDRYWRDYYDTSKEHERDIEYNLLDRIRYYWDYPDVREVLRKLFENFSEGVDIRFIYQYFYDSYEDVREGRMKNDPRELIKKEIKRVLEDYRYAIEL

SEQ ID NO: 255 - protein, 408 aa, Artificial Sequence
  mutant D-fructose C4-epimerase
MWESKRHGREHGVYSICSSNEWVIEASIEFAIRKGYYILIEATPHQVNQFGGYSGWTPEDFRRFVEEIAKRKGLEPRMIILGGDHLGPLPWQDEPEPTAMQKARELIRAFVESGYKKIHIDCSMPLSDDPDVLPDEEIARRTRELFEIAERYRQQFNFQPVYVVGTDVPIAGGGEEEGVTSVEDFRRAIEALKRYFPDVPNILDRVVGFVIMLGIGFSRDKVFEYDRDRVREILEEVKREDLFVEGHSTDYQARYALRNMVRDGVRILKVGPALTAAFRRGVFLLSEIEREIIPERRRQDIRRVILETMLRDDRYWRDYYETSDQLREDIEYNLLDRIRYYWDYPDVREVLERLFRNFSEGVDERYIYQYFYDSYQDVRDGRMTNDPRRLILKEIQLVLEDYAYAIYD

SEQ ID NO: 256 - protein, 408 aa, Artificial Sequence
  mutant D-fructose C4-epimerase
MWLRKRNGEPVGVYSICSSNRYVIEASIEFAQQYNREILIEATPHQVNQFGGYSGMTPRDFRRFVEEIAKSKGLEPRRILLGGDHLGPLPWQDEPEPTAMQKARELIRAFVESGYRKIHIDCSMPLSDDPETLDWREIARRTRELFEIAERTARTYPNEFVYVVGTDVPIAGGGEEEGRTSVEDFRSAIEWLRRYFQDVPNIWDRVVGFVIMLGITFSYQRVFEYDRDNVREILEEVRRTDLFVEGHSTDYQARYALRNMVEDGVRILKVGPALTAAFRRGVFLLSEIEREIIPERHRSNIREVILRTMLRDPRYWRDYYRDSEELRRDIEYNLLDRIRYYWNYPDVERVLQQLFRNFSEGVDERFIYRYFYDSYFDVREGKMQNDPRELIRKEIRIVLEDYAYAIEL

SEQ ID NO: 257 - protein, 408 aa, Artificial Sequence
  mutant D-fructose C4-epimerase
MWEEHDHNQPIGVYSICSSNPYVIRASIEFAKHRHEYILIEATPHQVNQHGGYSGMTPEDFRRFVMEIARQQGLDERQIILGGDHLGPLPWQDRPEPEAMEEARQLIRAFVESGYHKIHIDCSMPLSDDPKVLPYEEIARRTRELFEIARETAREEEFGSVYVVGTDVPIAGGGEEEGVTSVEDFRSAIEHLRQYFQDVPEIWRLVVGFVIMLGIGFTRDQVFQYDRDRVREILEEVKRNDLFVEGHSTDYQARYALRNMVEDGVRILKVGPALTAAFRRGVFLLSRIEDEIIPERERSNIREVILRTMLRDDRYWRDYYDDSDRLELDIWYNLLDRIRYYWDYEDVERVLRKLFENFSEDVDERFIYRYFYESYEDVRRGRMDTDPRELIKHEIKRVLRDYRYAIQR

SEQ ID NO: 258 - protein, 408 aa, Artificial Sequence
  mutant D-fructose C4-epimerase
MWESKRHNEPRGVYSICSSNPWVIEASIEFAMRQGDYILIEATPHQVNQFGGYSGMTPEDFRQFVMEIARRKGLDERMIILGGDHLGPLPWQDLPEPRAMEYARQLIRAFVESGYIKIHIDCSMPLSDQPDRLPLEEIARLTRELFEIAERYAQEFDREMVYVVGTDVPIAGGGEEEGVTSVEDFRSAIEALERYFDDVPNIRDRVVGFVIMLGIGFTYDQVFEYDRDRVEEILREVQRTDLFVEGHSTDYQARYALRNMVEDGVRILKVGPALTAAFRRGVFLLSLIEEEIIPERERQDIRRVILETMLRDPRYWRDYYDDSDRLELDIWYNLLDRIRYYWDYEDVRRVLELLFRNFSEGVDERYIYQYFYDSYEDVRRGRMEPDPRRLIHKEIILVLEDYAYAILT

SEQ ID NO: 259 - protein, 408 aa, Artificial Sequence
  mutant D-fructose C4-epimerase
MWLQQRNGQKWGVYSICSSNEYVIRASIEFAQESNTYILIEATPHQVNQFGGYSGMTPEDFKRFVMQIAREHGLDERRIILGGDHLGPLPWQDRPEPEAMNRARELIRAFVESGYRKIHIDCSMPLSDDPKVLDYREIARRTRELFREAEEQSSTDPNETVYVVGTDVPIAGGGEEEGRTSVEDFRSAIEELRRQFQDVPNIHDRVVGFVIMLGITFSRRRVFEYDRDQVREILEEVKREDLFVEGHSTDYQARYALRNMVEDGVRILKVGPALTAAFRRGVFLLSEIEREIIPERERSNIREVILRTMLRDDRYWRKYYEDSEQLREDIEYNLLDRIRYYWEYEDVKMVLNKLFENFSEGVDERFIYRYFYDSYFDVREGKMQNDPRELIRREIKEVLEDYRYAIEL

SEQ ID NO: 260 - protein, 408 aa, Artificial Sequence
  mutant D-fructose C4-epimerase
MWEEHDHLTKIGVYSICSSNPYVIEASIEFAQEQGDYILIEATPHQVNQHGGYSGMTPEDFKRFVMEIARRKGLDERMIILGGDHLGPLPWQDEPEPEAMEQAKQLIRAFVESGYYKIHIDCSMPLSDQPKVLPYEEIARQTRELFEIAEETQQETDREPVYVVGTDVPIAGGGEEEGVTSVEDFRSAIEHLERYFDDVPNIRDRVVGFVIMLGIGFTYRTVFEYDRDRVREILEEVKRTDLFVEGHSTDYQARYALRNMVEDGVRILKVGPALTAAFRRGVFLLSHIEQEIIPERERQDIQRVILETMLRDPRYWRDYYDDSDQLEEDIWYNLLDRIRYYWDYEDVRRVLEHLFRNFSEGVDERFIYRYFYDSYEDVRRGRMEPDPRELIKKEIKRVLEDYSYAINR

SEQ ID NO: 261 - protein, 408 aa, Artificial Sequence
  mutant D-fructose C4-epimerase
MWLERHYNLPKGVYSICSSNSYVIEASIEFAKNRHEPILIEATPHQVNQFGGYSGMTPTDFRDFVYKIAKEKGLDLRDIILGGDHLGPLPWQDLPAPEAMSRAEELIRAFVESGYRKIHIDCSMPLSDQPEVLHWWEIALLTRDLFAVAEEVARKFNFQLVYVVGTDVPIAGGGEEEGITSVEDFRSAIYYLKEAFRDVPNIWDRVVGFVIMLGIRFSYDRVFEYDRSRVEEILEEVKREDLFVEGHSTDYQARYALRNMVLDGVRILKVGPALTAAFRRGVFLLSNIEDEIIPERRRSEIKRVILETMLRDDRYWRKYYDDSKRLEWDIWYNLLDRIRYYWEYEDVKRVLERLFRNFSEPVDIKFIYQYFYDSYEDVRDGRMEPDPRELIKKEIKRVLEDYAYAIDL

SEQ ID NO: 262 - protein, 408 aa, Artificial Sequence
  mutant D-fructose C4-epimerase
MWEEKEYGQEQGVYSICSSNEYVIEASIEFAIEQGYYILIEATPHQVNHRGGYSGWTPEDFRRFVEEIARRKGLDERMIILGGDHLGPLPWQDRPEPEAMREAEELIRAFVESGYLKIHIDCSMPLSDWPDELPREWIARWTRRLFEIAERYRQTFNTEMVYVVGTDVPIAGGGEEEGVTSVEDFRSAIEYLRRYFPDVPNIRDRVVGFVIMLGIGFTRRRVFQYDRDRVREILEEVKRTDLFVEGHSTDYQARYALRNMVRDGVRILKVGPALTAAFRRGVFLLSNIEDEIIPERRRQNIKRVILETMLRDDRYWRKYYETSKRLEEDIWYNLLDRIRYYWQYEDVRRVLEELFRNFSEGVDERYIYQYFYDSYQDVRDGRMKNDPRELIKKEIKRVLEDYAYAIWR

SEQ ID NO: 263 - protein, 408 aa, Artificial Sequence
  mutant D-fructose C4-epimerase
MWLPHHYGRPFGVYSICSSNEWVIEASIRFAMRLHYPILIEATPHQVNHRGGYSGWTPTDFANFVYEIARRLGLSESMIILGGDHLGPLPWQDLPEPVAMNEARELIRAFVESGYWKIHIDCSMPLSDWSETLHWQVIADWTRELFREAEEQARGFNFWPIYVVGTDVPIAGGGEEEGRTSVEDFRSAIEYLRRYFNDVRNIWDRVVGFVIMLGIRFSRDRVFEYDRSQVEPILREVSRYDLFVEGHSTDYQARYALRNMVLDGVRILKVGPALTAAFRRGVFLLSEIEDRIIPERRRSEIMRVILETMLRDDRYWRDYYETGPQLEWDIFYNLLDRIRYYWDYPDVREVLRRLFENFSEPVPPDFIRDHFYESWRDVRDGRMRPDPRELIYHEIELVLRDYAYAILD

SEQ ID NO: 264 - protein, 408 aa, Artificial Sequence
  mutant D-fructose C4-epimerase
MWLRKQNNEKVGVYSICSSNPYVIEASIEFAMRLNDYILIEATPHQVNFQGGYSGMTPEDFREFVMRIARSKGLDERMIILGGDHLGPLPWQDLPRPQAMEYARQLIRAFVESGYRKIHIDCSMPLSDDPKVLDWRIIAEWTRELFEIAERTSPPVPNEMVYVVGTDVPIAGGGEEEGVTSVEDFRSAIETLREYFSDVPNIYDRVVGFVIMLGINFSYTEVFEYDRDKVRGILEEVKREDLFVEGHSTDYQARYALRNMVEDGVRILKVGPALTAAFRRGVFLLSQIEREIIPERHRSNIQRVILETMLRDDRYWRKYYRDDHQLELDIWYNLLDRIRYYWDYEDVRRVLELLFRNFSEGVDIKFIYQYFYDSYFDVRNGNMQNDPRELIKKEIMLVLEDYAYAIQL

SEQ ID NO: 265 - protein, 408 aa, Artificial Sequence
  mutant D-fructose C4-epimerase
MWLRHQNNEPVGVYSICSSNPYVIEASIRHAQRHNDYILIEATPHQVNQHGGYSGMTPEDFKEFVMRIARSTGLDERRIILGGDHLGPLPWQDQPEPEAMNQAEELIRAFVESGYQKIHIDCSMPLSDDPETLDYRRIAERTRRLFEVAERTSPPQPNQTVYVVGTDVPIAGGGEEEGVTSVEDFRSAIESLERYFEDVPNIRDRVVGFVIMLGINFSYDRVFQYDRDQVREILEEVRRTDLFVEGHSTDYQARYALENMVRDGVRILKVGPALTAAFRRGVFLLSNIEDEIIPERHRSNIKRVILETMLRDDRYWRDYYKDSKRLELDIWYNLLDRIRYYWDYEDVERVLRQLFENFSEGVDIKFIYQYFYDSYFRVRNGEMDTDPRELILAEIERVLEDYSYAIQL

SEQ ID NO: 266 - protein, 408 aa, Artificial Sequence
  mutant D-fructose C4-epimerase
MWEEHDYLQKFGVYSICSSNEYVIEASIEFAKEQGTEILIEATPHQVNHRGGYSGMTPEDFRRFVEEIARRKGLDEDKIRLGGDHLGPLPWQDQPEPTAMEEARELIRAFVESGYTKIHIDCSMPLSDDPDELPREEIARRTRELFEDAERHAQKYPEEPVYVVGTDVPIAGGGEEEGVTSVEDFRSAIERLKEYFPDVPNIRDRVVGFVIMLGIGFSRDKVFEYDRDRVREILEEVKREDLFVEGHSTDYQARYALRNMVEDGVRILKVGPALTAAFRRGVFLLSNIEDEIIPERRRQNIKRVILETMLRDDRYWRDYYETSDQLREDIWYNLLDRIRYYWQYDDVREVLRRLFENFSEGVDIKFIYQYFYDSYFDVREGKMKNDPRELIKKEIKRVLEDYSYAIHR

SEQ ID NO: 267 - protein, 408 aa, Artificial Sequence
  mutant D-fructose C4-epimerase
MWLRHEYGQPEGVYSICSSNEYVIRASIEFAKRKHERILIEATPHQVNQFGGYSGMTPEDFKREVMRIAREEGLDERQIILGGDHLGPLPWQDEPRPTAMNKAKDLIRAFVESGYRKIHIDCSMPLSDEPKVLDYREIAEQTRELFEIAEETRTEYNFQPEYVVGTDVPIAGGGEEEGVTSVEDFRSAIEHLERHFPDVENIRDRVVGFVIMLGIGFTRDRVFQYDRDQVREILEEVKRTDLFVEGHSTDYQARYALRNMVEDGVRILKVGPALTAAFRRGVFLLSNIEDEQIPERERSNIKRVILETMLRDDRYWRNYYDTSKRHEEDIWYNLLDRIRYYWEYEDVKMVLNKLFENFSEGVDIRFIYRYFYDSYEDVREGRMQNDPRRLIHHEIERVLRDYRYAIER

SEQ ID NO: 268 - protein, 408 aa, Artificial Sequence
  mutant D-fructose C4-epimerase
MWLMVQNNIPIGVYSICSSNPYVIEASIEFAMEKNSYILIEATPHQVNQFGGYSGMTPEDFKRFVMEIARSKGLEEDMIILGGDHLGPLPWQDEPAPTAMSKAQELIRAFVESGYLKIHIDCSMPLSDQPETLDWREIAILTRILFEVAERVAPPVPNLMVYVVGTDVPIAGGGEEEGVTSVEDFRSAIEWLYRYFSDVPNIADRVVGFVIMLGIGFSYDKVFEYDRDKVRGILEEVSREDLFVEGHSTDYQARYALRNMVLDGVRILKVGPALTAAFRRGVFLLSLIEREIIPERHRSDILRVILETMLRDPRYWRDYYRDSPALEDDILYNLLDRIRYYWEYEDVKRVLELLFRNFSEGVDIKFIYQYFYDSYFDVREGKMKNDPRELIKKEIKRVLEDYSYAILL

SEQ ID NO: 269 - protein, 408 aa, Artificial Sequence
  mutant D-fructose C4-epimerase
MWLSKQYNRKKGVYSICSSNPYVIEASIEFAKELDQYILIEATPHQVNQFGGYSGMTPEDFKNFVMKIAKEKGLDERRIILGGDHLGPLPWQDEPEPTAMEKARQLIRAFVESGYRKIHIDCSMPLSDQPKVLDWREIARLTRELFEIAERTAPEVPNEMVYVVGTDVPIAGGGEEEGVTSVEDFRSAIETLKRYFSDVPNIADRVVGFVIMLGIGFSYDKVFEYDRDRVEEILREVEREDLFVEGHSTDYQARYALRNMVEDGVRILKVGPALTAAFRRGVFLLSNIEDEIIPERERSNIKRVILETMLRDPRYWRDYYDDSPQLELDIWYNLLDRIRYYWDYPDVERVLRKLFENFSEGVDERFIYQYFYDSYFDVREGKMENDPRELIRKEIKRVLEDYSYAINL

SEQ ID NO: 270 - protein, 408 aa, Artificial Sequence
  mutant D-fructose C4-epimerase
MWLSKDYNEPKGVYSICSSNPYVIEASIEFAKHIHEPILIEATPHQVNQFGGYSGMTPEDFRRFVMKIAREKGLDERLIILGGDHLGPLPWQDEPSPTAMNKAQELIRAFVESGYRKIHIDCSMPLSDDPKVLPYEKIAERTRELFRIAEETAQDFPFLPVYVVGTDVPIAGGGEEEGVTSVEDFRSAIESLRKYFRDVPNIWDRVVGFVIMLGIRFSYREVFEYDRDKVRGILEEVKRMDLFVEGHSTDYQARYALRNMVEDGVRILKVGPALTAAFRRGVFLLSLIEEEIIPERERSNIREVILRTMLRDDRYWRKYYKDSDELEEDIWYNLLDRIRYYWDYEDVERVLRKLFENFSEPVDIRFIYRYFYDSYEDVRDGRMEPDPRELIKKEIKRVLEDYAYAIFT

SEQ ID NO: 271 - protein, 408 aa, Artificial Sequence
  mutant D-fructose C4-epimerase
MWLRKDNNEPVGVYSICSSNPYVIEASIEFAKELSDYILIEATPHQVNFQGGYSGMTPEDFKEFVMRIARSKGLEEDMIILGGDHLGPLPWQDLPEPQAMEYAKQLIRAFVESGYKKIHIDCSMPLSDQPETLDYREIARLTRELFEIAEETSPPQPNQPVYVVGTDVPIAGGGEEEGVTSVEDFRSAIESLRKYFSDVPNIWDRVVGFVIMLGIGFSYDKVFEYDRDQVREILEEVKRTDLFVEGHSTDYQARYALRNMVEDGVRILKVGPALTAAFRRGVFLLSQIEREIIPERERSNIQRVILETMLRDDRYWRKYYDDSPQLELDIWYNLLDRIRYYWDYPDVERVLRKLFENFSEGVDPRYIYRYFYDSAFDVRNGNMKNDPRELIKKEIKRVLEDYAYAIQL

SEQ ID NO: 272 - protein, 408 aa, Artificial Sequence
  mutant D-fructose C4-epimerase
MWLRKQNNEPVGVYSICSSNPYVIEASIEFAMRTNDYILIEATPHQVNQFGGYSGMTPEDFKEFVMRIARSKGLDERMIILGGDHLGPLPWQDEPEPTAMNKAKDLIRAFVESGYQKIHIDCSMPLSDQPKVLDYREIARLTRELFEIAEETAPPVPNTIVYVVGTDVPIAGGGEEEGVTSVEDFRSAIESLREYFEDVPNIWDRVVGFVIMLGIGFSYDKVFEYDRDQVREILEEVKRTDLFVEGHSTDYQARYALRNMVEDGVRILKVGPALTAAFRRGVFLLSQIEREIIPERERSDIRRVILETMLRDPRYWRDYYDDSPQLELDIWYNLLDRIRYYWEYEDVKMVLNKLFENFSEGVDIKFIYQYFYDSYFDVREGKMKNDPRELIKKEIMLVLEDYLYAIQL

SEQ ID NO: 273 - protein, 408 aa, Artificial Sequence
  mutant D-fructose C4-epimerase
MWLEKHYGREQGVYSICSSNEWVIEASIEFAMQLHNPILIEATPHQVNWSGGYSGWTPEDFRRFVEEIARRKGLDERLIILGGDHLGPLPWQDLPEPQAMQYAQELIRAFVESGYEKIHIDCSMPLSDDPETLDWRRIAERTRELFRIAEETASGFPFRPIYVVGTDVPIAGGGEEEGRTSVEDFRSAIEYLRQYFNDVRNIWDRVVGFVIMLGIRFSRDRVFEYDRDQVREILEEVRRYDLFVEGHSTDYQARYALRNMVQDGVRILKVGPALTAAFRRGVFLLSLIEEEIIPERRRSDIRRVILETMLRDDRYWRDYYETSDQLRLDIWYNLLDRIRYYWDYPDVREVLRRLFENFSEPVDPRFIYRYFYRSYEDVRDGRMQPDPRELIRKEIRLVLEDYSYAIND

SEQ ID NO: 274 - protein, 408 aa, Artificial Sequence
  mutant D-fructose C4-epimerase
MWLRHQYNEKVGVYSICSSNPYVIEASIEHAQEHNDYILIEATPHQVNQHGGYSGMTPEDFKRFVMEIARSKGLDERRIILGGDHLGPLPWQDQPEPEAMEQAKELIRAFVESGYRKIHIDCSMPLSDDPKVLDYRRIAERTRELFEIAEETSPPQPNETVYVVGTDVPIAGGGEEEGVTSVEDFRSAIESLRKYFSDVPNIHDRVVGFVIMLGIGFSYDKVFEYDRDQVREILEEVKRTDLFVEGHSTDYQARYALRNMVEDGVRILKVGPALTAAFRRGVFLLSQIEQEIIPERERSNIREVILRTMLRDDRYWRKYYDDSPQLELDIWYNLLDRIRYYWDYEDVERVLRKLFENFSEGVDIKFIYQYFYDSYFDVREGKMQNDPRELIKKEIKRVLEDYSYAIQL

SEQ ID NO: 275 - protein, 408 aa, Artificial Sequence
  mutant D-fructose C4-epimerase
MWLRKQNNEKVGVYSICSSNPYVIEASIEFAKEKGYYILIEATPHQVNQFGGYSGMTPEDFKEFVMRIARSKGLEEDKIILGGDHLGPLPWQDLPSPQAMEYAKELIRAFVESGYRKIHIDCSMPLSDDPETLPYEKIAERTRELFEIAEETSPPVPNEMVYVVGTDVPIAGGGEEEGVTSVEDFRSAIETLRQYFEDVPNIYDRVVGFVIMLGIGFSYDKVFEYDRDQVREILEEVKRTDLFVEGHSTDYQARYALRNMVEDGVRILKVGPALTAAFRRGVFLLSQIEREIIPERERSNIQRVILETMLRDDRYWRDYYDDSPQLELDIWYNLLDRIRYYWEYEDVKMVLNKLFENFSEGVDERFIYQYFYDSYFDVREGKMQNDPRELIKKEIKRVLEDYSYAIEL

SEQ ID NO: 276 - protein, 408 aa, Artificial Sequence
  mutant D-fructose C4-epimerase
MWLDHHYGRPFGVYSICSSNSYVIEASIEAAMNQHYPILIEATPHQVNHRGGYSGWTPEDFRRFVEKIAKEKGLSLSMIILGGDHLGPLPWQDYPSPWAMNEARELIRAFVESGYKKIHIDCSMPLSDDSETLPWRKIAEWTRELFREAEEQARGFPFQPVYVVGTDVPIAGGGEEEGRTSVEDFRSAIEELREYFRDVLNIWDRVVGFVIMLGIRFSRDRVFEYDRSQVEPILREVWRYDLFVEGHSTDYQARYALRNMVLDGVRILKVGPALTAAFRRGVFLLSLIEDEIIPERRRSEIPRVILETMLRDPRYWRDYYETSDQLRWDILYNLLDRIRYYWEYEDVKRVLEQLFRNFSEPVPPEFIRRYFYDSWEDVRDGRMRPDPRELIKKEIKRVLEDYWYAILD

SEQ ID NO: 277 - protein, 408 aa, Artificial Sequence
  mutant D-fructose C4-epimerase
MWERHEYGQAFGVYSICSSNEYVIEASIEFAITRHERILIEATPHQVNHRGGYSGMTPSDFRDEVFRIAREKGLDERLIILGGDHLGPLPWQDYPRPWAMNEARQLIRAFVESGYYKIHIDCSMPLSDEPEVLPWPEIAERTRDLFEEAERRRTQFNTEPWYVVGTDVPIAGGGEEEGITSVEDFRRAIEWLRRYFPDVMNIYDRVVGFVIMLGIGFTRDRVFYYDRDAVRPILWEVSRTDLFVEGHSTDYQARYALRNMVEDGVRILKVGPALTAAFRRGVFLLSLIEDEIIPERRRQEILRVILETMLRDPRWWRDYYDTSWWHEWDIFYNLLDRIRYYWDYPDVREVLERLFRNFSEGVHPEFIRRYFYDSYEDVRNGRMRNDPRELIKKEIKRVLEDYYYAIFW

SEQ ID NO: 278 - protein, 408 aa, Artificial Sequence
  mutant D-fructose C4-epimerase
MWLRFHYNEPIGVYSICSSNEYVIEASIEFAMHIHYPILIEATPHQVNQFGGYSGMTPTDFRDFVMKIAREKGLDERLIILGGDHLGPLPWQDLPAPQAMTYAKELIRAFVESGYLKIHIDCSMPLSDDPEVLHWEEIAERTRELFEIAEETARKYNFQLVYVVGTDVPIAGGGEEEGITSVEDFRSAIYYLKEYFRDVPNIWDRVVGFVIMLGIRFSYDVVFEYDRSQVEEILEEVKREDLFVEGHSTDYQARYALRNMVLDGVRILKVGPALTAAFRRGVFLLSNIEDEIIPERRRSQIKRVILETMLRDPRYWRDYYDDSDRLIWDIWYNLLDRIRYYWDYPDVYYVLLLLFWNFSEPVPLEHIRDYFYDSYEDVRDGRMSNDPRELIKKEIKRVLEDYAYAIWT

SEQ ID NO: 279 - protein, 408 aa, Artificial Sequence
  mutant D-fructose C4-epimerase
MWELHDNGQRFGVYSICSSNEYVIEASIEFAKNRHWRILIEATPHQVNQFGGYSGMTPEDFKREVMRIAREKGLEENMIILGGDHLGPLPWQDEPSPTAMNKAKDLIRAFVESGYYKIHIDCSMPLSDEPEVLPWPKIAERTRELFEIAEETRTQQNTEFWYVVGTDVPIAGGGEEEGITSVEDFRSAIEWLKRYFPDVPNILDRVVGFVIMLGIGFTRDTVFYYDRDAVRPILEEVKREDLFVEGHSTDYQARYALRNMVEDGVRILKVGPALTAAFRRGVFLLSLIEDEIIPERRRQEILRVILETMLRDDRYWRKYYSTSKSHEWDIFYNLLDRIRYYWDYPDVREVLRRLFENFSEGVHPSFIRDYFYDSYEDVREGRMKNDPRELIKKEIKRVLEDYWYAIYW

SEQ ID NO: 280 - protein, 408 aa, Artificial Sequence
  mutant D-fructose C4-epimerase
MWEEKDYGQRRGVYSICSSNEYVIEASIEFAKERGEYILIEATPHQVNQHGGYSGWTPEDFRQFVEEIARRKGLDPDKIILGGDHLGPLPWQDLPEPEAMREAKELIRAFVESGYKKIHIDCSMPLSDDPSVLPYQEIARRTRELFEIAAETARDQEFGRVYVVGTDVPIAGGGEEEGVTSVEDFRSAIEYLRRYFSDVPRIWDQVVGFVIMLGIGFSRDKVFEYDRDQVREILEEVKREDLFVEGHSTDYQARYALRNMVEDGVRILKVGPALTAAFRRGVFLLSRIEDEIIPERERSDIRRVILETMLRDDRYWRKYYEDSKRHELDIWYNLLDRIRYYWYYPDVREVLRKLFENFSEGVDERFIRRYFYDSYEDVRNGRMKNDPRELIKKEIKRVLEDYWYAINR

SEQ ID NO: 281 - protein, 408 aa, Artificial Sequence
  mutant D-fructose C4-epimerase
MWLEHHYGQKQGVYSICSSNQYVIEASIEFAKEQHHPILIEATPHQVNHRGGYSGMTPEDFRRFVEEIARRKGLDERLIILGGDHLGPLPWQDRPSPEAMEEARDLIRAFVESGYKKIHIDCSMPLSDDSETLPYRKIAERTRELFREAEETARKYNFQPVYVVGTDVPIAGGGEEEGRTSVEDFRSAIEYLKEYFRDVPNIRDRVVGFVIMLGIGFSRDKVFEYDRDQVREILEEVRREDLFVEGHSTDYQARYALRNMVEDGVRILKVGPALTAAFRRGVFLLSNIEDEIIPERERSNIKRVILETMLRDDRYWRKYYETSDQLREDIWYNLLDRIRYYWQYPDVQEVLRKLFENFSEPVDEEFIRRYFYDSYFDVREGKMRPDPRELIKKEIKRVLEDYSYAINL

SEQ ID NO: 282 - protein, 408 aa, Artificial Sequence
  mutant D-fructose C4-epimerase
MWLLHQYGQRFGVYSICSSNEWVIRASIQFAITRHHRILIEATPHQVNHRGGYSGMTPEDFKREVMRIAREEGLEENMIILGGDHLGPLPWQDYPRPWAMEEAKELIRAFVESGYYKIHIDCSMPLSDLPEVLHWSEIAEQTRELFEIAEETRTQQNTEFYYVVGTDVPIAGGGEEEGITSVEDFRSAIEQLRRHFPDVMNIYDRVVGFVIMLGIGFSRDKVFEYDRDAVRPILEEVKRTDLFVEGHSTDYQARYALRNMVEDGVRILKVGPALTAAFRRGVFLLSNIEDEQIPERERSNIKRVILETMLRDDRYWRKYYDTSKDHEWDIWYNLLDRIRYYWDYPDVREVLRKLFENFSEGVHPSFIRDYFYRSYEDVREGRMRNDPRELIFREIREVLQDYYYAIFW

SEQ ID NO: 283 - protein, 408 aa, Artificial Sequence
  mutant D-fructose C4-epimerase
MWLRKHYNEPQGVYSICSSNPYVIEASIEFAKHRGEYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARDYPFQPVYVVGTDVPIAGGGEEEGVTSVEDFRSAISSLKKYFNDVPNIWDRVVGFVIMLGIRFSYDRVFEYDRDQVREILEEVRREPLFVEGHSTDYQARYALRNMVEDGVRILKVGPALTAAFRRGVFLLSQIEDEIIPERERSNIRRVILETMLRDDRYWRKYYDDSDRLELDIWYNLLDRIRYYWDYEDVERVLRKLFENFSEPVDIRFIYRYFYDSYFDVREGKMEPDPRELIKKEIKRVLEDYRYAIDT

SEQ ID NO: 284 - protein, 408 aa, Artificial Sequence
  mutant D-fructose C4-epimerase
MWLDAHYGRPFGVYSICSSNEWVIRASIRFAKRLHYPILIEATPHQVNHRGGYSGMTPEDFKRFVMRIARELGLEENMIILGGDHLGPLPWQDYPSPWAMQEAKELIRAFVESGYWKIHIDCSMPLSDDSETLPYEKIAERTRELFEIAEETARGFNFWPIYVVGTDVPIAGGGEEEGVTSVEDFRSAISSLKKYFNDVPNIWDRVVGFVIMLGIRFSRDRVFEYDRDKVRGILEEVSREDLFVEGHSTDYQARYALRNMVLDGVRILKVGPALTAAFRRGVFLLSEIEREIIPERRRSRIRDVILETMLRDDRYWRDYYETSDQLRYDIEYNLLDRIRYYWNYPDVEEVLRRLFENFSEPVPPEFIRRYFYDSYEDVRDGRMQPDPRELIFHEIELVLRDYAYAILD

SEQ ID NO: 285 - protein, 408 aa, Artificial Sequence
  mutant D-fructose C4-epimerase
MWLRHQNNEPVGVYSICSSNPYVIRASIEFAKETNDYILIEATPHQVNQFGGYSGMTPEDFKRFVMEIARQTGLEEDRIILGGDHLGPLPWQDEPSPTAMEKARQLIRAFVESGYKKIHIDCSMPLSDQPETLPYEKIAEQTRELFEIAERTSPPQPNQPVYVVGTDVPIAGGGEEEGVTSVEDFRSAISSLKKYFNDVPNIWDRVVGFVIMLGIGFSYDKVFEYDRDQVREILEEVKREDLFVEGHSTDYQARYALENMVRDGVRILKVGPALTAAFRRGVFLLSQIEREIIPERHRSNIQEVILQTMLRDPRYWRDYYDDSPQLELDIWYNLLDRIRYYWDYEDVRRVLEQLFRNFSEGVDERFIYQYFYDSYFDVRNGNMKNDPRELIKKEIKRVLEDYRYAIQL

SEQ ID NO: 286 - protein, 408 aa, Artificial Sequence
  mutant D-fructose C4-epimerase
MWEQHRYNRKYGVYSICSSNSYVIEASIEFAQEKGTYILIEATPHQVNQFGGYSGMTPEDFKNFVMKIAKEKGLDERMIILGGDHLGPLPWQDEPSPTAMNKAKDLIRAFVESGYYKIHIDCSMPLSDDPDRLPYEKIAERTRELFEIAEETQQETDRQPVYVVGTDVPIAGGGEEEGVTSVEDFRSAISSLEKYFDDVPNIRDRVVGFVIMLGIGFSYDKVFEYDRDRVREILEEVKRTDLFVEGHSTDYQARYALRNMVEDGVRILKVGPALTAAFRRGVFLLSNIEDEIIPERERQNIKRVILETMLRDPRYWRDYYKDSKRLELDIWYNLLDRIRYYWEYEDVKRVLERLFRNFSEGVDERFIYRYFYDSYEDVRRGRMEPDPRELIKKEIKRVLEDYSYAINL

SEQ ID NO: 287 - protein, 408 aa, Artificial Sequence
  mutant D-fructose C4-epimerase
MWLLVQWNIKIGVYSICSSNPWVIIASILTAMEFNYYILIEATPHQVNQFGGYSGMTPSDFRDFVYEIALQLGLELDMIILGGDHLGPLPWQDLPAPRAMTYARQLIRAFVESGYLKIHIDCSMPLSDQPETLDWRQIAIYTRELFEVAERVAPPVPNLMVYVVGTDVPIAGGGEEEGVTSVEDFRSAIETLLRYFSDVPNIASRVVGFVIMLGIGFSYDKVFEYDRSQVLPILEEVKRTDLFVEGHSTDYQARYALRNMVEDGVRILKVGPALTAAFRRGVFLLSNIEDEIIPERHRSNIKRVILETMLRDPRYWRDYYRDSPALEDDIWYNLLDRIRYYWEYEDVKRVLELLFRNFSEGVDIKFIYQYFYDSYFAVREGKMSNDPRDLILWEIKLVLLDYWYAIIL

SEQ ID NO: 288 - protein, 408 aa, Artificial Sequence
  mutant D-fructose C4-epimerase
MWLRKHYGEPQGVYSICSSNEYVIEASIEFAKEKGDPILIEATPHQVNQFGGYSGMTPEDFKNFVMKIAKEKGLEEDKIILGGDHLGPLPWQDEPSPTAMNKAKDLIRAFVESGYEKIHIDCSMPLSDDPKVLPYEKIAERTRELFEIAEETARGFPFRPIYVVGTDVPIAGGGEEEGRTSVEDFRSAISSLKKYFNDVPNIWDRVVGFVIMLGIRFSRDRIFEYDRDQVREILEEVKREDLFVEGHSTDYQARYALRNMVEDGVRILKVGPALTAAFRRGVFLLSEIEREIIPERERSDIRRVILETMLRDDRYWRKYYEDSKQLELDIEYNLLDRIRYYWDYPDVREVLRKLFENFSEPVDIKFIYQYFYDSYEDVRDGRMRPDPRELIKKEIKRVLEDYSYAINN

SEQ ID NO: 289 - protein, 408 aa, Artificial Sequence
  mutant D-fructose C4-epimerase
MWLMVQNNLPYGVYSICSSNPYVIEASIEAAKEYNFYILIEATPHQVNQFGGYSGMTPEDFKEFVMRIARSKGLEEDMIILGGDHLGPLPWQDEPAPTAMNKAKDLIRAFVESGYKKIHIDCSMPLSDQPETLDYRIIAIYTRELFEIAEETAPPVPNQMVYVVGTDVPIAGGGEEEGVTSVEDFRSAISSLKKYFNDVPNIWDRVVGFVIMLGIGFSYDKVFEYDRDKVRGILEEVSREDLFVEGHSTDYQARYALRNMVLDGVRILKVGPALTAAFRRGVFLLSLIEREIIPERHRSDILRVILETMLRDDRYWRKYYRDSPALELDIFYNLLDRIRYYWMYPDVWTVLMLLFENFSEGVDERFIYLYFYDSYFDVREGKMKNDPRELIKKEIKRVLEDYWYAIIL

SEQ ID NO: 290 - protein, 408 aa, Artificial Sequence
  mutant D-fructose C4-epimerase
MWLLVQWNIPIGVYSICSSNSYVIEASIEAAMETDQYILIEATPHQVNQFGGYSGMTPEDFKNFVMKIARSKGLEEDMIILGGDHLGPLPWQDEPAPTAMNKAKDLIRAFVESGYKKIHIDCSMPLSDQPETLDYRQIAIYTRELFEIAEETAPPVPNQMVYVVGTDVPIAGGGEEEGVTSVEDFRSAISSLLKYFSDVPNIANRVVGFVIMLGIGFSYDKVFEYDRSQVEEILREVSRTDLFVEGHSTDYQARYALRNMVLDGVRILKVGPALTAAFRRGVFLLSLIEREIIPERERSDILRVILETMLRDPRYWRDYYRDSPALELDILYNLLDRIRYYWEYEDVKMVLNKLFENFSEGVDIKFIYQYFYDSYFDVREGKMLNDPRELIKKEIKRVLEDYWYAILL

SEQ ID NO: 291 - protein, 408 aa, Artificial Sequence
  mutant D-fructose C4-epimerase
MWLRKQYGHKEGVYSICSSNRYVIEASIEFAKELHSRILIEATPHQVNQFGGYSGMTPEDFKRLVMEIARRKGLDERLIILGGDHLGPLPWQDEPSPTAMQKARELIRAFVESGYYKIHIDCSMPLSDEPEVLPYEKIAERTRQLFEIAERYRRKYNTQPVYVVGTDVPIAGGGEEEGVTSVEDFRSAIESLRRYFPDVPNIRDRVVGFVIMLGIGFSRDKVFEYDRDKVRGILEEVKRTDLFVEGHSTDYQARYALRNMVEDGVRILKVGPALTAAFRRGVFLLSEIEREIIPERERSDIRRVILETMLRDDRYWRKYYDTSKEHERDIEYNLLDRIRYYWYYPDVERVLRKLFENFSEGVDIKFIYQYFYNSYEDVREGRMQNDPRELIKKEIKSVLEDYSYAIHR

SEQ ID NO: 292 - protein, 408 aa, Artificial Sequence
  mutant D-fructose C4-epimerase
MWLELLWNQPVGVYSICSSNSYVIEASIETAKEKGWYILIEATPHQVNFQGGYSGMTPSDFRDFVYQIAKEKGLELDKIILGGDHLGPLPWQDLPAPQAMEYAKILIRAFVESGYLKIHIDCSMALSDQPYYLDYRQIAIYTRELFEIAEETAPPVPNLMVYVVGTDVPIAGGGEEEGVTSVEDFRSAIETLKRYFSDVPNIFDRVVGFVIMLGIGFSYDKVFEYDRDKVRGILEEVKREDLFVEGHSTDYQARYALRNMVLDGVRILKVGPALTAAFRRGVFLLSLIEREIIPERERSDILRVILETMLRDPRYWRDYYKDSKRLELDILYNLLDRIRYYWEYEDVKMVLNKLFENFSEGVDERYIYLYFYDSYFAVRRGEMKNDPRELIKWEIILVLYDYWYAIIL

SEQ ID NO: 293 - protein, 408 aa, Artificial Sequence
  mutant D-fructose C4-epimerase
MWLMVQYNLPYGVYSICSSNPYVIEASIEAAKEYNFYILIEATPHQVNQFGGYSGMTPEDFKNFVMKIADSKGLERDMIILGGDHLGPLPWQDEPSPTAMNKAKDLIRAFVESGYKKIHIDCSMPLSDDPKVLPWEKIAERTRELFEIAEETAPPVPNQMVYVVGTDVPIAGGGEEEGVTSVEDFRSAIETLYRYFSDVPNIADRVVGFVIMLGIGFSYDKVFEYDRDKVRGILEEVKREDLFVEGHSTDYQARYALRNMVLDGVRILKVGPALTAAFRRGVFLLSLIEREIIPERERSDILRVILETMLRDDRYWRKYYKDSKRLELDILYNLLDRIRYYWDYEDVARVLNKLFENFSEGVDIKFIYQYFYDSYFDVRLGRMKNDPRELIKKEIKRVLEDYWYAIIL

SEQ ID NO: 294 - protein, 408 aa, Artificial Sequence
  mutant D-fructose C4-epimerase
MWLMLQYLINIGVYSICSSNPYVIEASIEAAQEYDLYILIEATPHQVNQFGGYSGMTPSDFRDFVMEIADRKGLERNRIILGGDHLGPLPWQDEPAPTAMAKAEELIRAFVESGYTKIHIDCSMPLSDDPETLPLEVIAERTRRLFEVAERTAREYNNQEVYVVGTDVPIAGGGEEEGVTSVEDFRSAIDTLRRYFEDVPNIYNRVVGFVIMLGIGFSYDKVFEYDRDKVRGILEEVKRTDLFVEGHSTDYQARYALRNMVLDGVRILKVGPALTAAFRRGVFLLSFIEQEIIPERERSNILRVILETMLRDPRYWRDYYDDSERLELDILYNLLDRIRYYWNYPDVETVLRKLFENFSEGVDPRFIYQYFYDSYFDVRRGLMKNDPRELIKKEIKRVLEDYFYAIIL

SEQ ID NO: 295 - protein, 408 aa, Artificial Sequence
  mutant D-fructose C4-epimerase
MWLEKHYGRKHGVYSICSSNEYVIEASIEFAMQKDEPILIEATPHQVNFSGGYSGWTPEDFRRFVEEIARRKGLDPDKIQLGGDHLGPLPWQDYPEPQAMQWARELIRAFVESGYEKIHIDCSMPLSDWPKVLPYEVIAEWTRELFRIAEETARKFNFRPIYVVGTDVPIAGGGEEEGRTSVEDFRSAISLLKKYFNDVPNIWDRVVGFVIMLGIRFSRDRVFEYDRDQVREILEEVRREDLFVEGHSTDYQARYALRNMVEDGVRILKVGPALTAAFRRGVFLLSNIEDEIIPERERSNIKRVILETMLRDDRYWRKYYETSDQLRLDIWYNLLDRIRYYWDYPDVREVLRKLFENFSEPVDIRFIYRYFYDSYEDVRRGQMRPDPRELIKKEIKRVLEDYSYAIHD

SEQ ID NO: 296 - protein, 408 aa, Artificial Sequence
  mutant D-fructose C4-epimerase
MWLMLQYLINIGVYSICSSNPYVIEASIEHAQETNDYILIEATPHQVNQFGGYSGMTPSDFRDFVMSIAKEKGLEENRIILGGDHLGPLPWQDEPAPTAMEKARQLIRAFVESGYTKIHIDCSMPLSDDPETLPLEVIAERTRELFEVAERTAREYNNQEVYVVGTDVPIAGGGEEEGVTSVEDFRSAISTLRDYFSDVPNIYNRVVGFVIMLGIRFSYDQVFEYDRSQVEEILREVSRTDLFVEGHSTDYQARYALRNMVLDGVRILKVGPALTAAFRRGVFLLSNIEREIIPERLRSNILRVILETMLRDPRYWRDYYDDSERLELDILYNLLDRIRYYWEYPDVEEVLRQLFENFSEGVDPRYIYQYFYDSYFDVREGKMQNDPRELIKKEIKRVLEDYTYAIQL

SEQ ID NO: 297 - protein, 408 aa, Artificial Sequence
  mutant D-fructose C4-epimerase
MWLMVQYNLPYGVYSICSSNPWVIEASIETAKQYNFYILIEATPHQVNQFGGYSGMTPSDFRDFVMEIARQKGLDERMIILGGDHLGPLPWQDLPSPQAMEYAKELIRAFVESGYLKIHIDCSMPLSDDPKVLPWEKIAERTRELFEIAEETARKYNFEMVYVVGTDVPIAGGGEEEGVTSVEDFRSAISTLLAYFSDVPNIARRVVGFVIMLGIGFSYDKVFEYDRDKVRGILEEVKRTDLFVEGHSTDYQARYALRNMVLDGVRILKVGPALTAAFRRGVFLLSLIEREIIPERERSDILRVILETMLRDPRYWRDYYRDSPALELDILYNLLDRIRYYWEYEDVKMVLNKLFENFSEGVDERYIYLYFYDSYFAVREGKMSNDPRDLILWEIILVLYDYWYAIIL

SEQ ID NO: 298 - protein, 408 aa, Artificial Sequence
  mutant D-fructose C4-epimerase
MWLMHEYGRKFGVYSICSSNSYVIEASIEFAKNRHHRILIEATPHQVNQFGGYSGMTPEDFKNFVMKIAKEKGLDERLIILGGDHLGPLPWQDEPRPTAMNKARELIRAFVESGYYKIHIDCSMPLSDEPKVLHWSRIAEDTRDLFEEAERRARKENTQFEYVVGTDVPIAGGGEEEGITSVEDFRQAIEQLIRHFPDVLNILDRVVGFVIMLGIGFTRDTVFYYDRDAVRPILEEVKRTDLFVEGHSTDYQARYALRNMVEDGVRILKVGPALTAAFRRGVFLLSNIEDEQIPERERSNIKRVILETMLRDDRYWRKYYSTSKSHEWDIWYNLLDRIRYYWYYPDVEWVLRKLFENFSEGVHPSFIRDYFYDSYEDVREGRMKNDPRELIKKEIKRVLEDYYYAIFL

SEQ ID NO: 299 - protein, 408 aa, Artificial Sequence
  mutant D-fructose C4-epimerase
MWERHDNLQKFGVYSICSSNEWVIRASIRFAKTRGERILIEATPHQVNHRGGYSGMTPSDFRDEVYRIAREEGLEEDRIILGGDHLGPLPWQDYPSPWAMEEAKELIRAFVESGYYKIHIDCSMPLSDEPEVLPWPKIAERTRELFEIAEETRTQFNTEFWYVVGTDVPIAGGGEEEGITSVEDFRSAIEWLKRYFPDVPNILDRVVGFVIMLGIGFTRDTVFYYDRDAVRPILEEVKREDLFVEGHSTDYQARYALRNMVEDGVRILKVGPALTAAFRRGVFLLSLIEFEQIPERERSNILEVILRTMLRDDRYWRKYYSTSKSHEWDIFYNLLDRIRYYWEYEDVKMVLNKLFENFSEGVHPSFILQYFYDSYFDVREGKMRNDPRELIHKEIMRVLEDYYYAIFW

SEQ ID NO: 300 - protein, 408 aa, Artificial Sequence
  mutant D-fructose C4-epimerase
MWLDQRNGQPWGVYSICSSNEYVIRASIEFAQEKDQYILIEATPHQVNQFGGYSGMTPEDFARFVYEIAREHGLREDRIILGGDHLGPLPWQDEPSPTAMQKARELIRAFVESGYYKIHIDCSMPLSDDPKVLPWPKIAERTRELFEVAERVAQWYPNLFVYVVGTDVPIAGGGEEEGRTSVEDFRSAIEWLRRYFEDVLNIWDRVVGFVIMLGIGFSYDKVFEYDRSQVFPILEEVKRTRLFVEGHSTDYQARYALRNMVLDGVRILKVGPALTAAFRRGVFLLSNIEDEIIPERERSNIKRVILETMLRDDRYWRKYYKDSKRLELDIWYNLLDRIRYYWDYPDVRRVLNKLFENFSEGVHESFIYRYFYDSYFDVRNGNMKNDPRELIKKEIKRVLEDYSYAIEL

SEQ ID NO: 301 - protein, 408 aa, Artificial Sequence
  mutant D-fructose C4-epimerase
MWLEHHYGRPFGVYSICSSNEYVIEASIEFAKELHYPILIEATPHQVNQFGGYSGWTPSDFRDFVFEIAKRKGLDLRLIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGRTSVEDFRSAISSLKKYFNDVPNIWDRVVGFVIMLGIRFSRDRVFEYDRSQVRPILEEVKREDLFVEGHSTDYQARYALRNMVLDGVRILKVGPALTAAFRRGVFLLSLIEDEIIPERERSDIPRVILETMLRDDRYWRKYYETSDQLRWDILYNLLDRIRYYWDYPDVREVLRKLFENFSEPVPIDFIRRYFYDSYFDVREGKMRPDPRELIKKEIKRVLEDYSYAIND

SEQ ID NO: 302 - protein, 408 aa, Artificial Sequence
  mutant D-fructose C4-epimerase
MWLRFHYNEPIGVYSICSSNPYVIEASIEAAMHVHEPILIEATPHQVNWQGGYSGMTPTDFRDFVMTIAREKGLDERLIILGGDHLGPLPWQDLPAPQAMTYAQILIRAFVESGYLKIHIDCSMPLSDWSEVLPWELIAELTRELFRVAEEVGQDMPFLMVYVVGTDVPIAGGGEEEGITSVEDFRSAIYYLFLYFNDVLNIRDRVVGFVIMLGIRFSYDVVFMYDRSQVEEILREVSRYPLFVEGHSTDYQARYALRNMVLDGVRILKVGPALTAAFRRGVFLLSLIEDEIIPERRRSQIIRVILETMLRDPRYWRDYYDDSDRLYWDILYNLLDRIRYYWLYPDVWYVLLLLFWNFSEPVDLRFILRYFYDSYEDVRDGRMSNDPRELIKKEIKRVLEDYWYAINL

SEQ ID NO: 303 - protein, 408 aa, Artificial Sequence
  mutant D-fructose C4-epimerase
MWLPAHYLREHGVYSICSSNRYVIEASIEFAQNMHEPILIEATPHQVNQFGGYSGWTPSDFRDFVYKIAKEKGLRLDLIILGGDHLGPLPWQDLPEPIAMQYARELIRAFVESGYKKIHIDCSMPLSDDPETLDLTRIAERTRELFREAEETARKYNFQPVYVVGTDVPIAGGGEEEGITSVEDFRSAIDRLREYFNDVPNIWDRVVGFVIMLGIRFSYDQVFEYDRDQVRPILEEVKREDLFVEGHSTDYQARYALRNMVQDGVRILKVGPALTAAFRRGVFLLSRIEDEIIPERERSNIREVILRTMLRDDRYWRKYYRTSEDLRYDIWYNLLDRIRYYWEYPDVQEVLRRLFENFSEPVPPNFIYQYFYDSYEDVRRGLMRPDPRELIKKEIKRVLEDYAYAIHD

SEQ ID NO: 304 - protein, 408 aa, Artificial Sequence
  mutant D-fructose C4-epimerase
MWLDHHYLLNIGVYSICSSNPYVIEASIEFAANMHLPILIEATPHQVNQFGGYSGMTPSDFRDFVMDIADRKGLDRNLIILGGDHLGPLPWQDLPAPQAMDYARQLIRAFVESGYTKIHIDCSMPLSDDPEVLPYEVIAERTRELFRVAEETAREYNFQAVYVVGTDVPIAGGGEEEGITSVEDFRSAIELLRRYFNDVPNIWDRVVGFVIMLGIRFSYDIVFEYDRSQVEEILREVSRENLFVEGHSTDYQARYALRNMVLDGVRILKVGPALTAAFRRGVFLLSHIEEEIIPERERSNIIEVILRTMLRDPRYWRDYYDDSERLEYDILYNLLDRIRYYWEYPDVRTVLELLFRNFSEPVPLSFIYQYFYDSYEDVRRGLMENDPRELIKKEIKRVLEDYAYAINL

SEQ ID NO: 305 - protein, 408 aa, Artificial Sequence
  mutant D-fructose C4-epimerase
MWLDAHYLRDIGVYSICSSNPYVIRASIIFAIRTGDYILIEATPHQVNQFGGYSGMTPSDFRDFVMSIADELGLDRNLIILGGDHLGPLPWQDLPAPRAMEYARQLIIAFVESGYTKIHIDCSMPLSDDPERLPLEVIARRTRELFEIAERYAQEYNVQPVYVVGTDVPIAGGGEEEGVTSVEDFRAAIEALRRYFDDVPNIFDRVVGFVIMLGIGFSYETVFEYDRSRVEEILREVSRDQLFVEGHSTDYQARYALLNMVRDGVRILKVGPALTAAFRRGVFLLSHIEEEIIPERERANIIEVILRTMLRDPRYWRDYYDDSERLEYDILYNLLDRIRYYWEYPDVLTVLERLFRNFSEGVDMRYIYQYFYDSYERVRRGEMTPDPRELILTEIMLVLEDYAYAIND

SEQ ID NO: 306 - protein, 408 aa, Artificial Sequence
  mutant D-fructose C4-epimerase
MWTDHNYLREIGVYSICSSNEYVIEASIEFAIEMGSYILIEATPHQVNQFGGYSGWTPSDFRDFVFEIADRKGLERNLIILGGDHLGPLPWQDLPEPRAMRYAEELIRAFVESGYTKIHIDCSMPLSDDPEVLPLERIAERTRRLFEVAERYRQQYNVQPVYVVGTDVPIAGGGEEEGVTSVEDFRAAIEALRRYFSDVMNIYDRVVGFVIMLGIGFSYQTVFYYDRSRVEPILREVSRTDLFVEGHSTDYQARYALRNMVQDGVRILKVGPALTAAFRRGVFLLSEIEREIIPERERSNIIEVILRTMLRDPRYWRDYYRTSEDLEYDILYNLLDRIRYYWNYPDVREVLRRLFENFSEGVDPRLIYQYFYDSYEDVRRGLMTNDPRELIKKEIKRVLEDYAYAIHD

SEQ ID NO: 307 - protein, 408 aa, Artificial Sequence
  mutant D-fructose C4-epimerase
MWLMLQYLINIGVYSICSSNSYVIRASIIAALRYDLYILIEATPHQVNQFGGYSGMTPSDFAEFVYRIAQEIGLEENRIILGGDHLGPLPWQDEPAPTAMNKAKDLIRAFVESGYTKIHIDCSMPLSDDPETLPLEVIAERTRELFEIAEETAREYNNQEVYVVGTDVPIAGGGEEEGVTSVEDFRSAISTLRDYFSDVPNIYNRVVGFVIMLGIRFSYDQVFEYDRSQVEEILREVSRTDLFVEGHSTDYQARYALRNMVLDGVRILKVGPALTAAFRRGVFLLSFIEQEIIPERERSNILRVILETMLRDPRYWRDYYRDSEDLELDILYNLLDRIRYYWEYPDVETVLRKLFENFSEGVDIKFIYQYFYDSYFSVRRGLMSNDPRDLILYEIMLVLEDYFYAIIL

SEQ ID NO: 308 - protein, 408 aa, Artificial Sequence
  mutant D-fructose C4-epimerase
MWLNQQYLRREGVYSICSSNPYVIEASIEFAQEYNRYILIEATPHQVNQFGGYSGMTPSDFRDFVFEIADRKGLERNRIILGGDHLGPLPWQDEPEPTAMNKARELIRAFVESGYKKIHIDCSMPLSDDSETLPYPRIAERTRILFEEAERTAREYNNQPVYVVGTDVPIAGGGEEEGVTSVEDFRSAIEYLRRYFLDVPNIWDRVVGFVIMLGIRFSYDQVFEYDRDNVRPILEEVKRERLFVEGHSTDYQARYALRNMVEDGVRILKVGPALTAAFRRGVFLLSNIEDEIIPERERSNIKRVILETMLRDDRYWRKYYRDSEDLRLDIWYNLLDRIRYYWNYPDVENVLRKLFENFSEGVDPRFIYQYFYDSYFDVREGKMKNDPRELIKKEIKRVLEDYAYAIEL

SEQ ID NO: 309 - protein, 408 aa, Artificial Sequence
  mutant D-fructose C4-epimerase
MWLLLQYLRNIGVYSICSSNPYVIEASIEFAKEKGDYILIEATPHQVNQFGGYSGMTPEDFKRFVMEIADRKGLERDKIILGGDHLGPLPWQDLPAPQAMEYAKELIRAFVESGYTKIHIDCSMPLSDDPKVLPLEVIAERTRELFEIAEETAREYNNQEVYVVGTDVPIAGGGEEEGVTSVEDFRSAIDTLRRYFSDVPNIYDRVVGFVIMLGIGFSYDKVFEYDRDKVRGILEEVSREDLFVEGHSTDYQARYALRNMVLDGVRILKVGPALTAAFRRGVFLLSFIEQEIIPERERSNILRVILETMLRDPRYWRDYYKDSKRLELDILYNLLDRIRYYWEYEDVKMVLNKLFENFSEGVDPRFIYQYFYDSYFDVREGKMKNDPRELIKKEIKRVLEDYSYAINL

SEQ ID NO: 310 - protein, 408 aa, Artificial Sequence
  mutant D-fructose C4-epimerase
MWLMLQYLINIGVYSICSSNPYVIRASIEFALETNDYILIEATPHQVNQFGGYSGMTPSDFREFVMRIAQEIGLEEDRIILGGDHLGPLPWQDEPSPTAMAKAEELIRAFVESGYKKIHIDCSMPLSDDPETLPLEKIAERTRRLFEVAERTAREYNNQEVYVVGTDVPIAGGGEEEGVTSVEDFRSAIDTLRRYFSDVPNIYNRVVGFVIMLGIGFSYDKVFEYDRSQVEEILREVSRTDLFVEGHSTDYQARYALRNMVLDGVRILKVGPALTAAFRRGVFLLSNIEDEIIPERLRSNIKRVILETMLRDPRYWRDYYDDSERLELDIWYNLLDRIRYYWEYEDVKIVLELLFRNFSEGVDPRFIYQYFYDSYFRVRNGDMKNDPRELIKYEIKRVLEDYLYAIQL

SEQ ID NO: 311 - protein, 408 aa, Artificial Sequence
  mutant D-fructose C4-epimerase
MWLSAQYLRKKGVYSICSSNPYVIEASIEFAQEYNTYILIEATPHQVNQFGGYSGMTPEDFKRFVMEIADRKGLERNRIILGGDHLGPLPWQDEPSPTAMAKAEELIRAFVESGYKKIHIDCSMPLSDDPKVLPLEKIAERTRRLFEVAERTAREYNNQEVYVVGTDVPIAGGGEEEGVTSVEDFRSAIETLERYFSDVPNIFDRVVGFVIMLGIRFSYDQVFEYDRDKVRGILEEVSREDLFVEGHSTDYQARYALRNMVEDGVRILKVGPALTAAFRRGVFLLSNIEDEIIPERLRSNIKRVILETMLRDDRYWRKYYDDSERLELDIWYNLLDRIRYYWEYEDVKIVLELLFRNFSEGVDPRFIYQYFYDSYFDVREGKMQNDPRELIKKEIKRVLEDYSYAINL

SEQ ID NO: 312 - protein, 408 aa, Artificial Sequence
  mutant D-fructose C4-epimerase
MWTDHDYLRRVGVYSICSSNEYVIRASIRFARDDDTYILIEATPHQVNQHGGYSGMTPSDFRDFVYRIADEEGLRRDLIILGGDHLGPLPWQDRPEPEAMNEARELIRAFVESGYKKIHIDCSMPLSDRPSSLPYPRIAERTRELFEEAERYAEQYNLQPVYVVGTDVPIAGGGEEEGVTSVEDFRSAIEYLREYFRDVENIWDRVVGFVIMLGIGFSYDKVFEYDRSQVEPILREVSRTDLFVEGHSTDYQARYALRNMVEDGVRILKVGPALTAAFRRGVFLLSRIEEEIIPERERSNIIEVILRTMLRDDRYWRNYYRDSEGLEYDILYNLLDRIRYYWEYEDVKMVLNKLFENFSEGVPINFIYQYFYESYENVRRGLMQNDPRRLILEEIMRVLRDYAYAIRL

SEQ ID NO: 313 - protein, 408 aa, Artificial Sequence
  mutant D-fructose C4-epimerase
MWLMLQYLINIGVYSICSSNPYVIEASIRFAQRTNLYILIEATPHQVNQFGGYSGMTPEDFKRFVMEIADRTGLERNRIILGGDHLGPLPWQDLPAPQAMEYAKELIRAFVESGYKKIHIDCSMPLSDDPETLPYEVIAERTRELFEIAEETAREYNNQEVYVVGTDVPIAGGGEEEGVTSVEDFRSAISSLRDYFSDVPNIYDRVVGFVIMLGIGFSYDKVFEYDRSQVAPILEEVKRTDLFVEGHSTDYQARYALRNMVLDGVRILKVGPALTAAFRRGVFLLSFIEQEIIPERERSNILEVILRTMLRDDRYWRKYYKDSKRLELDILYNLLDRIRYYWEYPDVETVLRKLFENFSEGVDIKFIYQYFYDSYFSVREGLMSNDPRDLILYEIMLVLEDYLYAIQL

SEQ ID NO: 314 - protein, 408 aa, Artificial Sequence
  mutant D-fructose C4-epimerase
MWLMLQYLINIGVYSICSSNSYVIEASIRAAQEYNLYILIEATPHQVNQFGGYSGMTPSDFRDFVMEIADRTGLERNRIILGGDHLGPLPWQDEPAPTAMEKARQLIRAFVESGYTKIHIDCSMPLSDDPKVLPLEVIAERTRELFEVAERTARKYNFQEVYVVGTDVPIAGGGEEEGVTSVEDFRSAIETLRAYFSDVPNIYDRVVGFVIMLGIRFSYDQVFEYDRDKVRGILEEVKREDLFVEGHSTDYQARYALRNMVLDGVRILKVGPALTAAFRRGVFLLSNIEEEIIPERERSNILEVILRTMLRDPRYWRDYYKDSKRLELDILYNLLDRIRYYWEYPDVETVLRKLFENFSEGVDIKFIYQYFYDSYFDVRRGLMSNDPRDLILAEIILVLRDYFYAIHL

SEQ ID NO: 315 - protein, 408 aa, Artificial Sequence
  mutant D-fructose C4-epimerase
MWLPAHYLREHGVYSICSSNEYVIEASIEFAKNMGEYILIEATPHQVNQFGGYSGWTPSDFRDFVYEIADRKGLERDRIILGGDHLGPLPWQDEPSPTAMNKAKDLIRAFVESGYKKIHIDCSMPLSDDPETLPYDKIAERTRELFEIAEETARQMNFQPVYVVGTDVPIAGGGEEEGVTSVEDFRSAIERLREYFRDVPNIWDRVVGFVIMLGIGFSGDKVFEYDRDKVRGILEEVSREDLFVEGHSTDYQARYALRNMVQDGVRILKVGPALTAAFRRGVFLLSRIEDEIIPERERSNIIEVILRTMLRDDRYWRKYYRTSKGLEYDILYNLLDRIRYYWNYPDVREVLRKLFENFSEPVDIKFIYQYFYDSYFDVREGKMRPDPRELIKKEIKRVLEDYAYAIHD

SEQ ID NO: 316 - protein, 408 aa, Artificial Sequence
  mutant D-fructose C4-epimerase
MWTDHAYLREIGVYSICSSNEYVIRASIRFAIEKGTYILIEATPHQVNQFGGYSGMTPEDFKRFVMEIADEEGLRRDLIILGGDHLGPLPWQDEPEPTAMQKARELIRAFVESGYTKIHIDCSMPLSDDPEVLDDERIARRTRELFEVAERYRQQYRVQPVYVVGTDVPIAGGGEEEGVTSVEDFRRAIDALRRYFSDVPNIFDRVVGFVIMLGIGFSGDQVFEYDRSRVEPILREVSREDLFVEGHSTDYQARYALRNMVRDGVRILKVGPALTAAFRRGVFLLSNIEDEIIPERERANIKRVILETMLRDDRYWRDYYKDSKRLELDIWYNLLDRIRYYWNYPDVREVLRRLFENFSEGVDPRYIYQYFYESYEDVRRGLMRNDPRDLILAEIMLVLRDYSYAIND

SEQ ID NO: 317 - protein, 408 aa, Artificial Sequence
  mutant D-fructose C4-epimerase
MWLPAHYLRRRGVYSICSSNEYVIEASIEFAKNMGDYILIEATPHQVNQFGGYSGMTPEDFKRFVMEIADRKGLRRDLIILGGDHLGPLPWQDEPEPTAMNKARELIRAFVESGYDKIHIDCSMPLSDDPETLALPRIAERTRELFREAEETARQMNFRPVYVVGTDVPIAGGGEEEGITSVEDFRSAIEYLRRYFNDVPNIWDRVVGFVIMLGIGFSGDKVFEYDRSQVRPILEEVKREDLFVEGHSTDYQARYALRNMVEDGVRILKVGPALTAAFRRGVFLLSRIEDEIIPERERSNIIEVILRTMLRDDRYWRKYYSTGKDLEYDILYNLLDRIRYYWNYPDVREVLRRLFENFSEGVDLSLIYQYFYDSYEDVRRGLMKNDPRELIKKEIKRVLEDYSYAIHD

SEQ ID NO: 318 - protein, 408 aa, Artificial Sequence
  mutant D-fructose C4-epimerase
MWLMQAYLIAIGVYSICSSNEYVIRASIRAAQNYNTYILIEATPHQVNQFGGYSGMTPSDFRDFVYRIADEEGLERNRIILGGDHLGPLPWQDLPEPQAMQYARELIRAFVESGYTKIHIDCSMPLSDDSETLPYPRIAERTRELFEVAERTAREYDNQPVYVVGTDVPIAGGGEEEGVTSVEDFRSAIEYLRRYFEDVMNIWDRVVGFVIMLGIRFSYQTVFEYDRSQVEPILREVSSTDLFVEGHSTDYQARYALRNMVLDGVRILKVGPALTAAFRRGVFLLSRIEQEIIPERLRSNILEVILRTMLRDDRYWRNYYRDSEDLRYDILYNLLDRIRYYWNYPDVEQVLRELFRHFSEGVDPRFIYQYFYDSYFRVRNGEMRNDPRDLIEAEIQEVLEDYFYAIIL

SEQ ID NO: 319 - protein, 408 aa, Artificial Sequence
  mutant D-fructose C4-epimerase
MWLSHDYLREHGVYSICSSNEYVIEASIRFAINMHDPILIEATPHQVNQFGGYSGWTPSDFRDFVYEIADRTGLERNLIILGGDHLGPLPWQDEPEPTAMQKARELIRAFVESGYDKIHIDCSMPLSDDPETLALPRIAERTRELFREAEEAARKMNFRPVYVVGTDVPIAGGGEEEGITSVEDFRSAIEYLRRYFNDVPNIWDRVVGFVIMLGIRFSYDQVFEYDRSQVRPILEEVKREDLFVEGHSTDYQARYALRNMVQDGVRILKVGPALTAAFRRGVFLLSNIEDEIIPERERSNIKRVILETMLRDDRYWRDYYRTSEGLRYDIWYNLLDRIRYYWNYPDVREVLRKLFENFSEGVDIKFIYQYFYRSYFDVREGLMRNDPRELILAEIMEVLRDYAYAIHD

SEQ ID NO: 320 - protein, 408 aa, Artificial Sequence
  mutant D-fructose C4-epimerase
MWLPAHYLREHGVYSICSSNEYVIEASIEFAIEMHDPILIEATPHQVNQFGGYSGMTPEDFKRFVMEIADRLGLERNLIILGGDHLGPLPWQDLPSPQAMQYARELIRAFVESGYTKIHIDCSMPLSDDPKVLPLPKIAERTRELFREAEETARQMNFQPVYVVGTDVPIAGGGEEEGITSVEDFRSAIDELRRYFNDVPNIWDRVVGFVIMLGIGFSYDKVFEYDRDQVRPILEEVKREDLFVEGHSTDYQARYALRNMVQDGVRILKVGPALTAAFRRGVFLLSNIEDEIIPERERSNIKRVILETMLRDDRYWRDYYSTSKDLEYDIWYNLLDRIRYYWNYPDVREVLRKLFENFSEPVPLSFIYQYFYLSYFDVREGLMEPHPERLIRAEIMEVLRDYSYAIHD

SEQ ID NO: 321 - protein, 494 aa, Pseudothermotoga thermarum
MKLLEEFLKAFPGRFKVYGSSLRIITDSYFFLGNDGKEKLLFVVGKKGICQLFDGQKIGQIGSNDVLMCKKTHENLLALRKIINLNPTTINKKASFGFGDRIGLATPAHAKVAKDFEVFPIFAQQSVRELSRTGRTYKDVLDDAVWGVFESGYNFEFGADADHVKEIEDLEKASNEGFTMYTVDPSDHIKDVSKLSQKEFQSLYQDNKIRRELEMRYVGKLYKFKDFEFRMTDEEFAEIFVTYIDAIEHVCKCYDVLKAKGKPFDFEVSIDETAVPTTPLAHIFIVKELRRRGIDFKTLALRFSGEWQKGIDYIGDMEMFRKEIITHSKISKELGGYKLSLHSGSDKFSVYPIFSEATEGEFHVKTAGTNYLEAIRVVAVKDPELYREIHKFALTKFEQDRKSYHVTTDLSKIPDVDKMKNEELVKLLDMPDSRQLIHITYGSVLTAKDENGRWLFKERILKVLQENEDLHYDFVEKHMRKHLSLLGLERRIEK

SEQ ID NO: 322 - protein, 487 aa, Pseudothermotoga hypogea
MFAEFQHLTRGKFVPYATSLRKSTDATFFLVRDELDKYLIVIGKKGICELFEGQKIGEIDRQDVVLCAKNDRNCQSLMSLFPSLKPQICNAKLSFGFGDRLGVATAAHAQCVQKEKLFPIFAQQSVREISRTERNWLDVLHSAVWGVFESGYDGPFGADADHVKKIEDLESAARAGYTMFTIDPSDHVKDPAKFDKRELVRFYEEHPMRRTLEMKYIGKSFTVLGEKLTFDEENFAEVFVTYIDAIEHVEKCYRALRAVCKTSFDLEVSIDETSVPTTSLAHIFFVQELVRRGVEFRTLALRFPGEWQKGIDYVGDIDLFSENLDKHVAIVKMFTGYRLSLHSGSDKFSVYPILAEKTDRTIHVKTAGTSYLEAIRVVAKFAPDLYRQIHKYALSRFDQDKASYHVTTELSKIPDVDKLEDSELPSLLDQPDSRQLIHITYGSVLTAKKEGRSLFKDRIMRVLFEHEAEHYDFLKKHLGKHIQLLGV

SEQ ID NO: 323 - protein, 489 aa, Pseudothermotoga lettingae
MAENIVEKFEKLFKGKYKIYYSSIRKLEKSFFFMIRDQKQKYLISIAKKRICEKFEGKKIGRINDLDILMCPTNDYNCKVIRTLFNINPSVCKKNTSFGFGDRLGLATPAHTTLINKYDVFPVLAQQSVRELSRTHRNFKDVLDSAIWGIFESGYEGEFGADADHVKDINDLMQAAYEGYSMYTVDPSDHVKNIDKINQGELVEFYKSHPLRKEIEMIYSGKVFSFEKSKFTMEDKELFRIFVTYVDAIEHVVKCYEAIKNTKKNFDFEVSIDETSIPTSPLAHIFIVHELRRRGVDFQTLALRFVGQWQKAIDYIGDLSVLESELSMHCEIVKSLSGYRLSLHSGSDKFSVYRIFTHYCDGKLHVKTAGTSYLEAIRTVAEASPSLYRNIHKYALTCFEKDNTSYHVTADINKIPDVDNVEDSKVVNLLDIPEVRQLIHITYGSVLTEKINGKYLFRDEIYRILHENEFLHYKRIRDHLGKHLELLKN

SEQ ID NO: 324 - protein, 519 aa, Rhodothermus marinus
MVTVLQTLLQRPRPLAEIDRTSLARFLTDVIRQQVYPTSLEPTSEGVFFLARDGREKRLGILSEAGLHDFEGVRHQLSLDGRTLIFQSCPLTAANARALRRHIPWTAPRPLGLRASVGCGDRLGLATPGHVRAVRKHKLAPVFAQQSIREMTRTGRTPQQVLDEAMWGVFQEGWRQGYGADADHLKTEEDADRCIEAGFTFFTIDPSAYVDNEVDTADAATLEAKVAALPWEALETTLADLRRAYLGQHFQVGPYELSFEERTLMQALAKYGGAIAHTARMYRHIAGRMGNRPFELEMSVDETEVPTSPAEHFFVARELQRLGVRWISLAPRFVGRLEKGVDYIGDLEEFEAHLKLHVAIARTLGPYKLSLHSGSDKFALYPLFARHAGELFHLKTAGTSYLEALRAVAELDPPLFREILDFARDRYETDRATYHVSALLERVPKASDVPDDALPALLEQFDTRQVLHVTFGSVLTATDADGRPRFRDRLLAVLQENEETYYRLLEAHFDRHLAPFDAE

SEQ ID NO: 325 - protein, 496 aa, Geosporobacter subterraneus
MDIYEKIAAALKDNRHNIQLDGVKIYPQSYVEVDMVKMIMVKAAEKKVILAQGSGPLFQELEGEAYDDYKVCNCSHLNRVVLNKYLPYTKPSAFGKEIATIGLGDRLGIASPGHIQAVKGREIRPILAQQSIRELNLTNRTYRNVLDAACFAVFQEGYKDGFGADGDHLKTEEDIQSALDLGFTMITLDCSEMIDNTIDKLTDTEVEEKYYQLPQSVRERYETRYLDKCFELRNSKICFSKENLMKNVLIYGAAADFIVAIYEKQIKHRDQKIDFEVSIDETVTPTTPEAHYFVAREIYDRQVDINSMAPRFCGEFQKGIDYIGDIHQFEKEFQVHAEIADHFGYKISIHSGSDKFSVFQTIGRYTEGRFHVKTAGTNWLEAVRVVAEKNPNLYRKMHQYALEHFDEARAYYHVTTDIEGIVPLEKVNDHELSQYMNENNARQLLHITYGILLQAKDASGQYLFREDFFYTLEQHEAEYDEALRKHIGRHLEQLGK

SEQ ID NO: 326 - protein, 517 aa, Melioribacter roseus
MEMQKLYEEVENKNIVKNDLVDLTIGESLKIKAYPLSVLKKDDAFFFIGKENYDKFLFVISAGKENGLLNEFEGELIDAGKDVTVKKCNLSTKNRKAVQKIFPHTAPIVLGLCNSFGCGDRLGVANAGHIRAIKQSNFRPILAQQSIRELTRTNRTPDDVMDAAVWAVLQEGYKDGFGSDADHLKTFEDIDLMLNAGFTMFTFDPSEHVDNEADNYSEDQLKQKLGEIDWSGLQDTSADAAKRYVDMTFNISERLSLTIQESDFLRAYAKYGNAIAHIKKMYDYLASKADKDTFEIEVSVDETESVTSPFEHFFFANELNRLGVKYVSLAPRFIGDFEKGIDYKGDLNVFKTEYEKHLDITKYFGSYKISLHSGSDKFSAYRVIGSLKGAYTHVKTAGTSYLEALRVVAAKEPALFRDILDFCRDLYETEKRSYHVSADINKVKPANQYSDTELIELFNQNDTRQVLHVTFGKVLTEKDSSGHFLFKDKIMKCLVENEESHYEFLEKHFLKHLECFK

SEQ ID NO: 327 - protein, 497 aa, Lysinibacillus sphaericus
MKQFLPAIELLAKGELPSNSNQIKVYEKSYTVEGNVHLLMVKNSGEKFILATGEGAIFDELTGTDVDGKGKACPLTYENRLVLNKYFDYTVPQAFGTEIATIGLGDRLGLASPGHIETVREKNIKPVLAQQSIRELTLTNRSMNDMLDAAAFAVFQEGYKGGYGADGDHIKEESDIQYALSLGASMITLDCSDHIDNTIEKASPEVLDEKFNALSEVVKQRYMEQYLGKTFEVNGLTLTLDETELKKNVLLYDKAIDYTTHVYNEYISKENRAIDFEISIDETETVTSPISHFFVANELINRGVKVVSLAPRFCGEFQKGIDYIGDVEQFEVELREHALIAEHFGYKLSIHSGSDKFMVFPIIAEYTKGVFHVKTAGTNWLEAIRVIAATNPDLYRRMHVFALENFEEALKYYHVTPDLNSFEKLENVEDAKLPEYMNNDAARQLFHVTYGLLLTAKGENDTFLFRDEFFKTLDKYEEEYRDALVSHIGKHIELLGL

SEQ ID NO: 328 - protein, 510 aa, Clostridium stercorarium
MGNWKDFVKDFCTKEKNIEVLRAEAEKAFGNYGVYPRSINEVGNAIVMMARGENEKCLVVVGEDSRLQELKGNQTEENGLKVKVCPLSNENCYVIRKIFPYTNPQPHKGKNITIGLGDRLGLASPGHIRLIRDLDVFPVLAQQSIRELNLTGRTYEDVISAAAWAVFQEGYTKGYGADGDHLKTAEEVKMSLNVGMTMITLDCSEHIDNSAAHAGLSELREKYSRFTEEERERWERKYLNRDVKIGNYSFHISEEDLIRMACVYGGAIRHTLDIYHNIIAKCGRPIDFEMSIDETLTPTSPASHYFVAQELIDGGVEITSLAPRFCGEFQKGIDYIGDLKQFTDEFAVHAAIADHFGYKISVHSGSDKFKVFPVVGEKTNGRYHLKTAGTNWLEAVRVIARHKPDLYRRMHAFALEHLEDAKKYYHIGAKVENIPALETLADSELPELMNRDDSRQVMHITYGHILQAKDENGNPLFKDELYKVLYEYEEEYANALKKHIGRHLEGLGLL

SEQ ID NO: 329 - protein, 488 aa, Truepera radiovictrix
MPSQLPEPLPVPPEARAHPSFRLHEGAALWLAGARLAVLAPPEHPALTRFRGEVQHVGDHRLLRAERRAENAAALRALLPDLQPRPLGLVTSAGFGDRLGVATPGHVRAAQRYGAGVAPVFAQQSIREMTRTGRTPQEVLDDATWGAFAAGWRGALGADADHQKTVADLERCAAAGFTLFTVDPSDHVDDSAHGAPASDLEAKVAALPWRELETTRADFERYAGRRLELGDRELVLAREAVLRAGAKYARAVLHVATLYRHLEGKGAPFELEVSVDETATPTSHAEHAVVALELRRLGVRWVGLAPRFVGRFEKGVDYRGDLGELKADLAGHAALARSLGPYKLSLHSGSDKFSVYPLIAEATGGMVHLKTAGTSYLEALRVAAQVAPGLFREILTLGRERFAVDKQSYHISAALARVSEADTLTDDELPRLLDDDDARQVLHVTFGSALDRYRAPLLRVLEAHDEAYQAGLAAHFAKHLTPFAEVAP

SEQ ID NO: 330 - protein, 485 aa, Dictyoglomus turgidum
MLKLLNESLKPLSIFIYSESLRKINDDLYIFVAKIKDLKKIGIVKQNQILYFSSPYFSEDKKIEGTNFLVNLYPLNFENYQKLKEIIPISPKVCDKKISFGTGDRLGLITSAQLSALKEYDLFPILAQQSPRELIKTKRDFKDVLLKSAMGVLETGYTGKYGADADHIKDEKYLMEAIDAGYTMYTLDISDFIEKIKDLSEKALKEKYEKVSSFSKKIIDKYAGKRVKISDEEYFELSYNELCKSAIVYEKALSFVEMVYEILKSKLSEFDIEVSIDEGERDTTPEDHFFVAQFLHDKGIDFKSLAPKFPGEFQKGIDYIGDIKEFERALKKHYALTKALEGYRLSLHSGSDKFSIYKIFYKITEGNFHIKTSGTSWLEAVKVIAKFFPDLFVELYQIALENLEESKKAYKVNITKEEFPKEIKEDYMEFLHKDNVRQLFHISYGVLLDEKRKEIYDLLNQKEKEHYQYVSENIKKHLKNLFEEE

SEQ ID NO: 331 - protein, 465 aa, Caldilinea aerophila
MNDAVYALGRSSRNGTLQLIVRGNSTGFHGEQQGDALICPLDAENARTLQERLPWLRPQPLGNRLSFGFGDRIGLATPGHVDALRSADPTGRIAPIFAQQSVRENQRLNRTPQEVMTAAVWSLFAENWRLPWGADADHVKEPEHLAPYVAAGYTFYTIDPSDHVDNAAHTDDLAVLRSKCEALPWDILETTYLSLCENYCGRTIVAEKTTLHFDKETLLRALAKYGRALAHTVRIAAALRTALGGTSFDLEMSVDETDTPTSAHEHFFIANELLRRNIPLVSLAPRFVGKFQKGVDYMGNLAEFEAELIRHVAVMRHFHCYKLSVHTGSDKFSIYPILARCAGENVHIKTAGTSYLEALRVAALRAPDLFRQMLETGRTCYEKDKKTYFLDCRPERVPPAATLDDADLPNLLDQFDARQLLHVTFGSILTTHGAALRNLLATYPNDYRSALRDHFARHIQPFVQA

SEQ ID NO: 332 - protein, 474 aa, Thermoflexus hugenholtzii
MMLSPEALAEGLRLYGLHLIVGSIRELPDGGAIFAARQGSERRIGWIGETSPFPAPDPRMSMRVQEHLVWIHPWTWAHYRILRERLPALSPTRCDRPASFGAGDRLGMATAAQIAALERYPVFPVLAQQSPRELARTGRDFRSVLLDAAWGVFASGFAGPFGADADHLQDDEQLRAAAEAGYSLYTFDLRRALARGPRPWEALSPLARSVVAELADRRVEAPQGPRTLEESALRAAACRYEPALEEVVRGAEILRDQGIDADLEVSVDETEEETTPEAHAFIAVYLQRRGVALWSLAPRFPGVFEKAVDYEGEVERFAQAAALHTAVARTFGGHRLSLHSGSEKFRILPVFREATGGRFHVKTSGTTWLQAVRVVARAVPALFAELYAIARAHLEESRRDYPIALQPEALPPALPDDPEAALADRAVRQLFHISYGVLLRERGPAIRALLEAHEAEHFTAVRENLERHLEALLK

SEQ ID NO: 333 - protein, 483 aa, Thermoanaerobacterium thermosaccharolyticum
MIGNVLSTLEENGFKVYPDSLRKLGENIYIFVVKRQNEKMVGILSSSDVKLNGAYFSEDKNVSDKLRLNIYPFTFENYVTLNGKFHIGPTVCRGNSSFGTGDRLGLVTAAQLTALKKYDVFPILAQQSPRELIKTNRDFKDVLLKVVLGVLETGYIGHFGADADHIKDEYYLLEGINAGYTMYTLDLSEQLIDISSLNPSEMRNKAQELSQVSKDIIKDFSGKKLDIISDSGYVVSEEELYKSAVAYENAMKFVDKVNNILKEKLSDFDMEISIDEGGKVTTLEDHLYVAEYLHRNGIDFFSIAPKFPGEFEKAVDYIGDLDEFLLELKKHYQLSRMIGGYKISLHSGSDKFSIYRIFSDITEKNFHIKTSGTSWLQAINLIYNYDKEFYRELYKIALENLEESKKSYKVLIKREDFCKEPELNNPKFILKPEIKQLFHISFGVLLNLKRKEIVDFLNKYEEEHYKMVSKNIDNHLKEIFYKN

SEQ ID NO: 334 - protein, 385 aa, Petrotoga mobilis
MFTILPKKGISLGLGDRIGIATPGHIKVAKKYNFFPVFAQQSIRELNFTGRTFTDVRKDVLNALVEENYVGNSGFDGDHLKSDEEIQYALDSGITMLTLDCSEHMNKDSSIKDQIFEQFYNKSFFVNDMPIEYSDKNELNKIVSIYASVIERVIDVWNKFPKVNKKEVTFEVSVDETDVPTDEKTHFLISKYIYDEGVKIDTLAPRFPGEFQKAIDYIGNIQEFKKSLIKQDKIAKYFGYRLSIHSGSDKFSIYPIIGEVTQGNYHLKTSGTSYLEAIKVVAQKDPEFFKKIWQTCLDKREEMDKYYHLSCDPFSVPKDLSPTEYLQNPDARQTLHVSYMFVLNPQYDFREKFFEILTKYQNEYHENVANHIEKHVKELKIEEKS

SEQ ID NO: 335 - protein, 426 aa, Spirochaeta thermophila
MATPGSLSFPRYSIGTGDRFGHEAEAQLRAVIEAGRLGRALGIVWNKSYREHTIIGSRPEDVRRMADRAVSSLGWEGPYFVDADHITTKTVDLFLDSADFFTIDVAEAIGKGEVSPQEEEDLLASLGDLLNRELAIPGLSSPLAISEETARGTIRAYWPAVREAARIYRRIEQGASRPFVVEVSMDETDEPQRPPELLLILAMIRKAGIPARTIAPKFSGAFYKGVDYVGDPHTFAREFEDDLCVVRYAREQFALPEGLKLSVHSGSDKFSLYPLVREILSRHPQEGVHLKTAGTTWLEEVAGLAEAGGEALALAKEIALTCYSMIEELCAPYAAVIDIDPERLPSPGEIEEWSSGRFVEALEHDPSNPSYNRDFRQLIHVGYKVAAQMGERFHQALEAHREVIAARVTRNLLERHIIPLFPGDIP

SEQ ID NO: 336 - protein, 480 aa, Thermofilum pendens
MLHVYLGKIPRPGFGIRIPEVVAPPLLSAFKSLGMTGSLMLSFNRETAPAEYIESSDPRLFYFGHTGTSIGGFIRSVKEYSKALSVPVEVEADHVSILGSVERALKKIAGVPVEEPLSEEEVSWSIGYVERELREAAEAGGVDFVTIDTCELIDYSYDKVGAEEVAAAYEEVFDGDERRALEERYEGVHYFLGGDRVVAVRLSREDVARLAVKYRRSLDYAERIYRAAREAMGVELGFEVAFDETPGVSEAREVFFYLSELLRRGLRVDFIAPNVGFRKREDYSGDLHALYERLRNLHAVVSSMNAYLSIHSGSGSHPYSDKGFGVWGVVGRATGGAVKYKMSGVLVQLLLEVMASYPPGSETRRLYEEIYSEVVEHLRWVVKAKASLYSPELETLLKRYEAAQDRFDPRADVFRHYFYVFQALRDEGGARRLRERLVEHYRENPGLRERYEKELRGLVERLASQLGYAGNAYRYRVVYA

SEQ ID NO: 337 - protein, 519 aa, Rhodothermus marinus
MVTVLQTLLQRPRPLAEIDRAALARFLTDLIRQQVYPASLEPTSEGVFFLARDGREKRLGILSEAGLHDFEGARHQLSLDGRTLIFQSCPLTAANARALRQHLAWTAPRPLGLRASVGCGDRLGLATPGHVRAVRKHKLAPVFAQQSIREMTRTGRTPQQVLDEAMWGVFQEGWRQGYGADADHLKTEEDADRCIEAGFTFFTIDPSAYVDNEVDTADAATLEAKVAALPWDALETTLADLRRAYLGQHFQVGPYELSFEERTLLQALAKYGGAIAHTARVYRHIAGRMGNRPFELEMSVDETEVPTSPAEHFFVARELQRLGVRWISLAPRFVGRLEKGVDYIGDLEEFEAHLKLHVAIARTLGPYKLSLHSGSDKFALYPLFARHAGELFHLKTAGTSYLEALRAVAELDPPLFREILDFARDRYETDRATYHVSALLERVPKASDVPDDALPALLEQFDTRQVLHVTFGSVLTATDADGRPRFRDRLLAVLQENEETYYRLLEAHFDRHLAPFDAK

SEQ ID NO: 338 - protein, 485 aa, Dictyoglomus thermophilum
MLNLLEELLKPFSIFVYPQSLRKINEELYIFVAKINNTKNIGIIKQNQSIYFSNPYFSEDKKIEKTGFSVNIYPLNFENYQKLKEIIPINPKTCNKKISFGTGDRLGLVTSAQLSVLKDYNLFPILAQQSPRELIKTKRDFKDVLLKSVIGVLEIGYTDSYGADADHIKDEKYLMEAIDAGYTMYTLDISDFIERIENLTSKEIREKYEKISSFSKKIIEKYAGKKIKISNEEYFELSYDELCKSAIVYEKALSFVEMVYEILRSKLLEFDIEVSIDEGERDTTPEDHFFVVQFLHEKGIDFKSLAPKFPGEFQKGIDYIGDIKKFENELKKQYALTKALEGYRLSLHSGSDKFSIYKSFYKITEGNFHIKTSGTSWLEAVKTIARYSPDLFLELYHIALENLEESKKAYKVSITKEEFPKEIKEDYIEFLKKPNVRQLFHISYGVLLDEKREEIYEILNKNEKEHYQYVSENIRKHLKNLFEEE

SEQ ID NO: 339 - protein, 483 aa, Thermoanaerobacter siderophilus
MKEELSDYLLKNSFLLYPDSFRRLREDVYIFVAKKDSDKKIGLLTNGNFKLSSPHFAEDKYVEELGFYINLYPLTYENYLILKDNFGISPVTCKEKASFGTGDRLGLATPAHIKALKNYNVFPVLAQQSPRELVKTHRDFKDVFLKVILGVLEAGYAGGYGADADHIKDEKYLIEAIDAGYTMYTLDLSDLLVKISDMPKSQLKEKAQSLSSQSREIIDRFKGKKFSISTDEDFAVSEDELYKSALTYEKAMKFVEKVYGILKDRLQHFDLEISIDEGEKDTTVEDHIFVAEYLHRKGIDFWSLAPKFPGEFQKAIDYKGDIKKFTSGLKKHYFLSKKLGGYKLSLHSGSDKFSIYKIFNEITEGNFHIKTSGTSWLQAINIIFERDKDLFNDLYKIALDNLEESKKAYKVLIDRDDFPQTIQTEDSQILLKPEIKQLFHISYGVLLDERRKEIYEVLNKYEEEHYEFVSKNIENHLKEIFNI

SEQ ID NO: 340 - protein, 482 aa, Thermoanaerobacter mathranii
MVEKSILEKLTDFLLNHSFVLYPNSLRKLKEDTYIFVAKKDADKKIGILTKENFKLTSPYFVEDKNVKEIDFYLNLYPLSFENYLILKNFGISPTPCRQKSSFGTGDRLGLVTPAHIVALKEYPVFPVLAQQSPRELEKTHRDFKDALLKVILGVLEAGYTGEFGADADHIKDEKYLLRAIEAGYTMYTLDVSELLTKILDISSNQVMQISPQSKEIIEAFKGKKISISEEEYTIREDELYKSALIYEKAMNFVEKVYSILKEKVKDFDLEISIDEGEKDTTVEDHIFVAEYLHKKGIDFWSLAPKFPGEFQKAIDYKGDINKFAVELKKHYAISQQLGGYKLSLHSGSDKFSIYEIFSEVTQHSFHIKTSGTSWLQAVNLIFEKNKKLFYELYKIALNNLEESKKAYKVLIDKDDFAEEPNLENVQILSQPEIKQLFHISYGVLLDEKKEEIYDVLDKYEEEHYQFVSANIKNHLGKIFNN

SEQ ID NO: 341 - protein, 482 aa, Thermoanaerobacter italicus
MVEKGILEKLTDFLLNHSFVLYPNSLRKLKEDTYIFVAKKDADKKIGILTKENFKLSSPYFVEDKNVKEIDFYLNLYPLSFENYLILKNFGISPTPCRQKSSFGTGDRLGLVTPAHIVALKEYPVFPVLVQQSPRELEKTRRDFKDALLKVILGVLEAGYTGEFGADADHIKDEKYLLRAIEAGYTMYTLDVSELLTKISDISSNQVMQISPQSKEIIEAFKGKKISISEEEYTIREDELYKSALIYEKAMNFVEKVYSILKEKVKDFDLEISIDEGEKDTTVEDHIFVAEYLHKKGIDFWSLAPKFPGEFQKAIDYKGDINKFAVELKKHYAISQQFGGYKLSLHSGSDKFSIYEIFSEVTQHSFHIKTSGTSWLQAVNLIFEKDKKLFYELYKIALNNLEESKKAYKVLIDKDDFAEEPNLENAQILSQPEIKQLFHISYGVLLDEKKEEIYDVLDKYEEEHYQFVSANIKNHLEKIFNK

SEQ ID NO: 342 - protein, 483 aa, Thermoanaerobacterium thermosaccharolyticum
MIGNVLSTLEENGFKVYPDSLRKLGENIYIFVVKRQNEKMVGILSSSDVKLNGAYFSEDKNVSDKLRLNIYPFTFENYVTLNGKFHIGPTVCRGNSSFGTGDRLGLVTAAQLTALKKYDVFPILAQQSPRELIKTNRDFKDVLLKVVLGVLETGYIGHFGADADHIKDEYYLLEGINAGYTMYTLDLSEQLIDISSLNPSEMRNKAQELSQVSKDIIKDFSGKKLDIISDSGYVVSEEELYKSAVAYENSMKFVDKVNNILKEKLSDFDMEISIDEGGKVTTLEDHLYVAEYLHRSGIDFFSIAPKFPGEFEKAVDYIGDLDEFSLELKKHYQLSRMIGGYKISLHSGSDKFSIYRIFSDITEKNFHIKTSGTSWLQAINLIYNYDKEFYRELYKIALENLEESKKSYKVLIKREDFCKEPELNNPNFILKPEIKQLFHISFGVLLDLKRKEMVDFLNKYEEEHYKMVSKNIDNHLKEIFYKN

SEQ ID NO: 343 - protein, 483 aa, Thermoanaerobacterium thermosaccharolyticum
MIGNVLSTLEENGFKVYPDSLRKLGENIYIFVVKRQNEKMVGILSSSDVKLNGAYFSEDKNVSDKLRLNIYPFTFENYVTLNGKFHIGPTVCRGNSSFGTGDRLGLVTAAQLTALKKYDVFPILAQQSPRELIKTNRDFKDVLLKVVLGVLETGYIGHFGADADHIKDEYYLLEGINAGYTMYTLDLSEQLIDISSLNASEMRNKAQELSQVSKDIIKDFSGKKLDIISDSGYVVSEEELYKSAVAYENAMKFVDKVNNILKEKLSDFDMEISIDEGGKVTTLEDHLYVAEYLHRNGIDFFSIAPKFPGEFEKAVDYIGDLDEFLLELKKHYQLSRMIGGYKISLHSGSDKFSIYRIFSDITEKNFHIKTSGTSWLQAINLIYNYDKEFYRELYKIALENLEESKKSYKVLIKREDFCKEPELNNPKFILKPEIKQLFHISFGVLLNLKRKEIVDFLNKYEEEHYKMVSKNIDNHLKEIFYKN

SEQ ID NO: 344 - protein, 483 aa, Thermoanaerobacterium thermosaccharolyticum
MIGNVLSTLEENGFKVYPDSLMKLGENIYIFVVKRQNEKMVGILSSSDVKLNGAYFSEDKNVSDKLRLNIYPFTFENYVTLNGKFHIGPTVCRGNSSFGTGDRLGLVTAAQLTALKKYDVFPILAQQSPRELIKTNRDFKDVLLKVVLGVLETGYIGHFGADADHIKDEYYLLEGINAGYTMYTLDLSEQLIDISSLNPSEMRNKAQELSQVSKDIIKDFSGKKLDIISDSGYVVSEEELYKSAVAYENAMKFVDKVNNILKEKLSDFDMEISIDEGGKVTTLEDHLYVAEYLHRNGIDFFSIAPKFPGEFEKAVDYIGDLDEFLLELKKHYQLSRMIGGYKISLHSGSDKFSIYRIFSDITEKNFHIKTSGTSWLQAINLIYDYDKEFYRELYKIALENLEESKKSYKVLIKKEDFGKEPELNNPKFILKPEIKQLFHISFGVLLDLKRKEIVDFLNKYEEEHYKMVSKNIDNHLKEIFYKN

SEQ ID NO: 345 - protein, 483 aa, Thermoanaerobacterium thermosaccharolyticum
MIGNVLSTLEENGFKVYPDSLRKLGENIYIFVVKRQNEKMVGILSSSDVKLNGAYFSEDKNVSDKLRLNIYPFTFENYVTLNGKFHIGPTVCRGNSSFGTGDRLGLVTAAQLTALKKYDVFPILAQQSPRELIKTNRDFKDVLLKVVLGVLETGYIGHFGADADHIKDEYNLLEGINAGYTMYTLDLSEQLIDISSLNASEMRNKAQELSQVSKDIIKDFSGKKLDIISDSGYVVSEEELYKSAVAYENAMKFVDKVNNILKEKLSDFDMEISIDEGGKVTTLEDHLYVAEYLHRNGIDFFSIAPKFPGEFEKAVDYIGDLDEFLLELKKHYQLSRMIGGYKISLHSGSDKFSIYRIFSDITEKNFHIKTSGTSWLQAVNLIYKFDKEFYRKLYKIALSNLEESKKSYKVLIKKDDFKDEPELDNPEFTLRPEIKQLFHISFGVLLDLKGKEIKDMLNDYEEEHYKMVSDNIENHLKEIYYEK

SEQ ID NO: 346 - protein, 482 aa, Thermoanaerobacterium xylanolyticum
MVGNVSSVLKESGFQIYPDSLRKLGENTYIFVVKKQKEKMIGILSNDELKLKEPYFSENKKISDNLQFNVYSFTFDNYVTLNGRFHIGPTICRENASFGTGDRLGLATAAQLDALKKFNVFPILAQQSPRELVKTNRDFKDVLLKVVLGVLETGYIGHYGADADHIKDEKYLLEGIDAGYTMYTLDLSEQLFDVSGATSLEIKEKAKTLSDVSRKIVEDFSGKSLNVGFGGHLVSEDELLKSAVAYEAAMKFVEKVNDILKEKLNDFDLEISIDEGGKVTTLEDHLFVAEYLHRNGIDFFSIAPKFPGEFEKAIDYVGDVNEFERELKKHYDLTKLIGGYKLSLHSGSDKFSIYKIFSQTTEKNFHIKTSGTSWLQAVNLIYKSDKEFYRELYKIALSNLEESKKSYKVLIKKDDFKDEPELDNSEFIIRPEIKQLFHISFGVLLDLKGKEIKDMLYDYEEEHYKMVSDNIENHLKEIFYEK

SEQ ID NO: 347 - protein, 386 aa, Petrotoga mobilis
MLTILPNKGISLGLGDRIGIATHGHIKVAKKYNFFPVFAQQSIRELNFTGRTFSDVRKDVLNALIEENYVGNSGFDGDHLKSDEEIQYALDSGITMLTLDCSEHMNNKDSSIKERIFDQFYNKSFFVNDMPIEYSNKNELNKIVSIYAGVIERVIDVWNKFPKVNKKEVTFEVSVDETDVPTDEKTHFLISKYIYDEGVKIDTLAPRFPGEFQKAIDYIGNLQEFKKSLIKQDKIAKYFGYRLSIHSGSDKFSIYPIIGEVTQGNYHLKTSGTSYLEAIKIVAQKDPEFFKKIWKTCLDKREEMDKYYHLSCDPFSVPKNLSPTEYLQNPDARQTLHVSYMFVLNPQYDFREKFFEILTKYQNEYHQNVANHIEKHVKELKVEEKS

SEQ ID NO: 348 - protein, 482 aa, Thermoanaerobacterium saccharolyticum
MVGNVSAVLKENGFKIYPDSLRKLGESTYIFVVKKQKEKMIGILSNDELNLKEPYFSENKKISDNLQFNVYPFTFDNYVTLNGRFHIGPTVCRENASFGTGDRLGMATAAQLGALKKFDVFPVLAQQSPRELVKTNRDFKDVLLKVVLGVLETGYIGHYGADADHIKDEKYLLEGIDAGYTMYTLDLSEQLFDISGATPSAIKEKAEALSDVSKKIVEDFSGQSLNVGLEGHLVSEDELLKSAIAYEGAMKFVEKVNDILKEKLNDFDLEISIDEGGKVTTLEDHLFVAEYLHRNGIDFFSIAPKFPGEFEKAIDYVGDVDEFKKALKKHYDLTKLIGGYKLSLHSGSDKFSIYKIFSQTTERNFHIKTSGTSWLQAVNLIYKSDREFYRELYKIALSNLEESKKSYKVLIKKDDFKDEPELDNPEFIVRPEIKQLFHISFGVLLDLKGKEIKDMLYEHEEEHYKMVSNNIENHLKEIYYEK

SEQ ID NO: 349 - protein, 390 aa, Petrotoga mobilis
MFTILPKRGISLGLGDRIGIATTGHIKVAKKYNFFPVFAQQSIRELNFTGRTFIDVRKDALNALVEENYVGNSGFDGDHLKSDEEIQYALDSGITMLTLDCSEHMNKDSSIKDQIFEQFYNKSFFVNDMPIEYSDKNELNKIVSIYASVIERVIDVWNKFPKVNKKEVTFEVSVDETDVPTDEKTHFLISKYIYDEGVKIDTLAPRFPGEFQKGIDYIGNIQEFKKSLIKQDKIAKYFGYRLSIHSGSDKFSIYPIIGEVTQGNYHLKTSGTSYLEAIKVVAQKDPEFFKKIWQTCLDKREEMDKYYHLSCDPFSVPKDLSPTEYLKNPDARQTLHVSYMFVLNPQYDFREKFIEILTKYQNEYHQNAANHIEKHVKELKVEEKIHKQKN

SEQ ID NO: 350 - protein, 426 aa, Spirochaeta thermophila
MTTPGSLSLPRYSIGTGDRFGHEAEAQLRAVIEAERLGMALGIVWNKSYREHTIIGSRPEDVRRMADKAVSALEWEGPYFVDADHITTKTVELFLDSSDFFTIDVAEAIGQEEISPQEEEDLLSSLDDLLNRELAIPGLSNPLTISEETARETIRAYWPAVREAARIHQRIEKGTSRPFVVEVSMDETADPQRPPELLLILAMIRKAGIPARTIAPKFSGSFYKGVDYVGDPEVFAREFEDDLCVVRYAREAFRLPEGLKLSVHSGSDKFSLYPLIKDILSRHPQEGVHLKTAGTTWLEEVTGLAESGGEALALAKEIALTCYSMIEELCAPYAAVIDINPDRLPSPGEIEDWSSGRFVEALEHDPSNPSYNRDFRQLIHVGYKVAAQMGERFHEALEAHREVIAARVTRNLLERHIIPLFPGGAA

SEQ ID NO: 351 - protein, 256 aa, Ignisphaera aggregans
MRAKELFGEDVSIEIALDESPSETQLKELFFYINELLYKGLRFEFIAPNIGFRKREDYRGDLQELYNRVRKLHTIASNNGVYLSIHSGSGAHPYSDKGVGVWSTIGRATDGLVKYKMSGVLIQLLLEVMSRFPKGSTVRRVYEEIYDAVLDHLKKDISRGRGLASETLRKMIEDYEEHSNKYDVRADVFRHYFFVFQCIRDDSGVRYLRNRVIELFNEVKELRDRYREEVANLITREAEALGYINSVIRYRKYEYS

SEQ ID NO: 352 - protein, 481 aa, Thermotoga maritima
MVLKVFKDHFGRGYEVYEKSYREKDSLSFFLTKEEEGKILVVAGEKAPEGLSFFKKQRAEGVSFFFCERNHENLEVLRKYFPDLKPVRAGLRASFGTGDRLGITTPAHVRALKDSGLFPIFAQQSVRENERTGRTWRDVLDDATWGVFQEGYSEGFGADADHVKRPEDLVSAAREGFTMFTIDPSDHVRNLSKLTEKERNEKFEEILRKERIDRIYLGKKYSVLGEKIEFDEKNLRDAALVYYDAIAHVDMMYQILKDETPDFDFEVSVDETETPTSPLFHIFVVEELRRRGVEFTNLALRFIGEWEKGIDYKGDLAQFEREIKMHAEIARMFEGYKISLHSGSDKFSVYPAFASATGGLFHVKTAGTSYLEAVKVISMVNPELFREIYRCTLDHFEEDRKSYHISADLSKVPEVEKVKDEDLPGLFEDINVRQLIHVTYGSVLKDASLKERLFKTLEQNEELFYETVAKHIKRHVDLLEG

SEQ ID NO: 353 - protein, 483 aa, Caldanaerobacter subterraneus
MINKVAEYLSGEGFYFYEKSFRKLSEDIYIFVVKKANEKSIGLLTQGDFTLSSPHFTERKYLKETGYYLNLYPLTYENFVILKDKFNIAPAPCDKKASFGMGDRLGLVTAAHIRAVENYDVFPVLAQQSPRELMKTHRSFKEAILKAILGVLEEGYTGKFGADADHIKDENYLMEAIDAGYTMYTLDLSDMLVKLSDYTESQLKEKAEKLNITSKRIIERFKGKKFVMPTKEAFTVSEEELYKSALTYEKAMDFVEKVYGILKDKVKNFDLEISIDEGDKDTTVEDHIFVAEYLHEKGIDFWSLAPKFPGEFQKAIDYIGDVDKFAVELKKHQFLSREFGGYKLSLHSGSDKFSIYKVFSEITEGEFHIKTSGTSWFQAVNLIFEKDKELFKELYQIALYNLEESKKAYKVLIDKKDFPENINLEDSQIVSKPEIKQLFHISYGVLLEERKKQIFEVLNKYEEEHYEFVRKNIENHFKEIFSK

SEQ ID NO: 354 - protein, 499 aa, Mesotoga infera
MKENKVMNSFSAIYGNRYKVYEKSLKRKEKEFFFVIKDFQRKYLVAAGPSYRIRKRDFQPDEEGVADNEGEFLFQICRLTHHNLTQLQSIFNYLQPSTTKMKPSFGTGDRLGIATPAHIQAFEDKNIFPILAQQSVREMERTESNWQKVLDNAIWGCFEAGYEGKFGADADHVKDLKNLKEAIDCGFTFYTIDPSDHIDANILKLDKDELRNKYQQLPEKDALENSYLNKEYQIGSQKLTFTQDILIEIVLTYLEAIKHVEKCYKFLKDSHKGDFELEVSVDETPTPTSPLAHLWIASELQRRGVDFQNLAPHFIGDWEKGIDYIGNIDTFKEEFKLHCQIASQMGGYKLSLHSGSDKFSVYPIFAEETNGYFHVKTAGTSWLEAVKAIVVCDPALYREMYEFALKCFEKDSFSYLLSTDLQKIPNIKELQDKELIQLFSNNNARQLIHITYGSILREKDSQNRYKFRDRIYKVLFENEDIHYENVSKHIRHHLGLLSV

SEQ ID NO: 355 - protein, 502 aa, Thermosinus carboxydivorans
MQSREELKRAILSEFGDYNIYSESIYRAGGCVLFLAKDMGQKLLVVVEEETGSAFDRFVGPQVYHPSGKRVKEAPLQPVNAGIVRELLPFTAPVALGATGLSLGLGDRLGVASPGHLRLIKKTGVRPVLAQQSVRELTLTNRTYSDVLDAATWAVLQEGYEGGFGADGDHLKTAEEIKGALDLGFTMITLDASAHIDNTVGQKAAKQVAELYHTLPADYTADMEEHYLGKAFIVGGMAITFDTETLQRLVLTYGKALAFMGYIYHTLIVNAGREVDFEISIDETATPTTPAAHYFVASELGRMGVKFTSLAPRFCGEFQKGIDYIGDLYQFEDEFKRHAAIADHFGYRLSIHSGSDKFSVFPIIGQYTRGRVHIKTAGTNWLEALRVVARINPALFREIYAFAGEVFGEAKKYYHVTTDLTRLPDVAAMADDGLPTVLDHNDARQMLHITYGLVLTAANADGSYRFKDALYELLFDHEDEYYAALERHIGRHLEKLTENLKG

SEQ ID NO: 356 - protein, 507 aa, Halanaerobium congolense
MSWKDFAEELVGTSKEAVMKVAEYAEDYRIYPRSIIKKDKSFYFLAKIDQKKKLVILNKSKNFELFQGRIEELAGFKAKIGPLSHYNAEILREVFPFTAPSALGNKKPSIGLGDRLGIATPGHIEAVKESAAMPVFAQQSVRELNLTGRTFKSVLDDVSWAVFQEGYQAGFAADADHLKEKPDIKEALDLGYTMLTLDCTDYINDDLDQMSESEIENAYAEVPDYLREGLENQYLNKTFVLNSGYQLEYNQDNFKEIVLIYYKMLDFAKEIQHLIKTSARNVDFEISIDETSTPTTPEAHFFVANELKRNNIEVNSLAPRFVGEFQKGIDYIGDLEQFEKEFKVHADIADRFGYKLSIHSGSDKFSVFPIIGRHTQGRVHVKTAGTNWLEAIRVVAENNPSLYRDIHAYALKKFEAAKEYYHVTTDLDKVPELARMSDQELGELLEINEVRQLLHITYGFILQDKKDGRYIFRDKLYKFWDEYDKEYRRALERHIGRHLNKLGFYKN

SEQ ID NO: 357 - protein, 507 aa, Halanaerobium congolense
MSWKDFAEELVGTSKEAVMKVAEYAEDYRIYPRSIIKKDKSFYFLAKIDQKKKLVILNKSKNFELFQGRIEELAGFKAKIGPLSHYNAEILRKVFPFTAPSALGNKKPSIGLGDRLGIATPGHIEAVKESAAMPVFAQQSVRELNLTGRTFKSVLDDVSWAVFQEGYQAGFAADADHLKEKPDIKEALDLGYTMLTLDCTDYINDDLDQMSESEVENAYAEVPDYLREGLENQYLNKTFVLNSGYQLEYNQDNFKEIVLIYYKMLDFAKEIQHLIKTSARNVDFEISIDETSTPTTPEAHFFVANELKRNNIEVNSLAPRFVGEFQKGIDYIGDLEQFEKEFKVHADIADRFGYKLSIHSGSDKFSVFPIIGRHTQGRVHVKTAGTNWLEAIRVVAENNPSLYRDIHAYALKKFEAAKEYYHVTTDLDKVPELARMSDQELGELLEINEVRQLLHITYGFILQDKKDGRYIFRDKLYKFWDEYDKEYRRALERHIGRHLNKLGFYKN

SEQ ID NO: 358 - protein, 507 aa, Halanaerobium saccharolyticum
MSWKDFAEELVGTSKDAVKKVAEYAEDYRIYPRSIIKKEKSFYFLAKIDQKKKLVILNKSKNFDIFQGKTEKLAGFKAKIAPLSHYNAEIIREVFPFTAPSKIGNQTASIGLGDRLGIATPGHIEAVKKSNAMPVFAQQSVKELKLTGRSFKSVLDDVSWAVFQEGYQNGFGADADRLKEKPEIKEALDLGYTMLTLDCTDYINDNFDQTAESDIESAYAEVPDYLRDGLESKYLNKTFVLNSGYQLEYNKVNFKKIVLSYYQILDFVKEIQHLIKRSARDVDLEISIADSLNSTSPEAHFFVANEFKRNNIEVNSLALNFVGEFQKGIDYIGDLEKFEKDFEIHADIADRFGYKLSIHSGSDKFSIFPIIGRQTEGRAHIKTAGTNWLEAIRVVAENDPSLYREIHSYALKKFEEAKEFYQVNTDLSKVPELAVMSDQELGELLEIDAVRQLLHITYGFILQDKKDGRYIFRDRLYKLLDEYDKDYRSGLERHIGRHLNKLGFYKN

SEQ ID NO: 359 - protein, 504 aa, Gracilibacillus halophilus
MVKHFESVLEELSQRKVPTSTEEVTVYTPSFEEHAGSQVVMVKSGTEKMIVAAGAGELFEALSGEDIGKGKVCPLTHENRLVLNQFFSYTAPQAFGTDIATMGLGDRLGIASPGHIDTVKERNVKPILAQQSIRELTLLNRTMTDILDAAAFAVFQEGYKDGYGADADHIKLESDIEHALQLGFSFLTLDCSEQIRNDVESQTSDEIQNEFASLSDEKRAYFSNYYLDQTFNVHERQISFDQANLAKNVLVYGEAIDFMEHVYHTYLQSLDRDVDFEISIDETETVTSPEAHFFVAEELRRRGVKVESLAPRFCGEFQKGIDYIGDMDQFEKELKEHADIAKHFGYKLSIHSGSDKFSVFPIIGKYTDGLLHIKTAGTNWLEAVRVVAQENPDLYRRMHVYAEEHFEETLKYYHVTPDLDSVTPLKEQPDDQLPEYMNHDAARQLFHVTYGILLTAKDDAGNDLFRDEFFDTLLNKEDAYRQALAHHIGRHLDLLGLSKKVGIE

SEQ ID NO: 360 - protein, 483 aa, Caldanaerobacter subterraneus
MINKVAEYLSREGFHFYEKSFRKFSEDIYIFVVKKANEKSIGLLTQRDFTLSSPYFTERKYLKEIGYYLNLYPLTYENFVILKDKFSIAPSPCNKKVSFGMGDRLGLVTAAHIRAVQNYDVFPVLAQQSPRELMKTHRSFREAILKAILGVLEEGYTGKFGADADHIKDENYLMEAIDAGYTMYTLDLSDMLVKLSDYTESQLKEKAEKLNITSKRIIEKFKGKKFVMPTEEAFTVSEEELYKSALTYEKAMDFVEKVYGILKDKVKNFDLEISIDEGDKDTTVEDHIFVAEYLHEKGIDFWSLAPKFPGEFQKAIDYIGDVDKFAVELKKHQFLSREFGGYKLSLHSGSDKFSIYKVFSEITEREFHIKTSGTSWLQAVNLIFEKDKKLFKELYQIALYNLEESKKAYKVLIDKKDFPENINLEDSQIVSKPEIKQLFHISYGVLLEERKKQIFEVLNKYEEEHYEFVRKNIENHFKEIFSK

SEQ ID NO: 361 - protein, 418 aa, Litorilinea aerophila
MLPYLVARPLGLRKSAGCGDRLGLATPGHIRALRATFGRDEDAAMAPIFAQQSIRENARTGRTPQEVMDDAMWGVFQEGWRAGFGADADHLKTLADVDICAAAGYTFYTVDPGDHVDDEANTAAFPALEARVDALPWDVLDSSPADLAARLADRPIDLGTLKVTLDRETLWRAAAKYGRAVAHTVTMYRHLAGAMGERPFELEMSVDETATVTSLAEHVYIAAELQRLGVRCVSLAPRYVGTFEKGVDYIGDLDAFEQSIAQHMAVSRTFGPYKLSLHSGSDKFSIYPIASRVAGDLVHLKTAGTSYLEALRAIAAMAPDLFRQIVAFARERYPTDRASYHVSAELEKMPDIAGWPDDRLPELLNDFHAREILHVTFGSVLNHPPFREPFFTALRTHEETYSEMLERHFCRHFAPFAG

SEQ ID NO: 362 - protein, 483 aa, Caldanaerobacter subterraneus
MINKVAEYLSREGFYFYEKSFRKFSEDIYIFVVKKANEKSIGLLTQGDFTLSSPYFTERKYLKEIGYYLNLYPLTYENFVILKDKFSIAPSPCNKKVSFGMGDRLGLVTAAHIRAVENYDVFPVLAQQSPRELMKTHRSFKEAILKAILGVLEEGYTGKFGADADHIKDENYLMEAIDAGYTMYTLDLSDMLVKLSDYTESQLKEKAEKLNITSKRIIERFKGKKFVMPTKEAFTVSEEELYKSALTYEKAMDFVEKVYGILKDKVKNFDLEISIDEGDKDTTVEDHIFVAEYLHEKGIDFWSLAPKFPGEFQKAIDYIGDVDKFAVELKKHQFLSREFGGYKLSLHSGSDKFSIYKVFSEITEGEFHIKTSGTSWLQAVNLIFEKDKELFKELYQIALYNLEESKKAYKVLIDKKDFPENINLEDSQIVSKPEIKQLFHISYGVLLEERKKQIFEVLNKYEEEHYEFVRKNIENHFKEIFSK

SEQ ID NO: 363 - protein, 490 aa, Caldanaerobacter subterraneus
MFERKIEMINKVAEYLSREGFYFYEKSFRKFSEDIYIFVVKKANEKSIGLLTQGDFTLSSPYFTERKYLKEIGYYLNLYPLTYENFVILKDKFSIAPSPCNKKVSFGMGDRLGLVTAAHIRAVENYDVFPVLAQQSPRELMKTHRSFKEAILKAILGVLEEGYTGKFGADADHIKDENYLMEAIDAGYTMYTLDLSDMLVKLSDYTESQLKEKAEKLNITSKRIIEKFKGKKFVMPTEEAFTVSEEELYKSALTYEKAMDFVEKVYGILKDKVKNFDLEISIDEGDKDTTVEDHIFVAEYLHEKGIDFWSLAPKFPGEFQKAIDYIGDVDKFAVELKKHQFLSREFGGYKLSLHSGSDKFSIYKVFSEITEGEFHIKTSGTSWLQAVNLIFEKDKKLFKELYQIALYNLEESKKAYKVLIDKKDFPENINLEDSQIVSKPEIKQLFHISYGVLLEERKKQIFEVLNKYEEEHYEFVRKNVENHFKEIFSK

SEQ ID NO: 364 - protein, 483 aa, Caldicoprobacter faecalis
MGMMDKDVLNQLSSLLSRHSFVLYPNSVRNLAEDIYVFVAKGNADKKVGILSKGKALGFKAPFFAEDIKVEATGFSFNLYPLSFENYLILRDEFGIALVPCKNKASFGTGDRLGLATPAHLDAFKSYNMFPVLAQQSPRELEKTHRDFRDVLLKAVLGVLEAGYTGEFGADADHIKDERYLLEAADAGYTMYTLDVSEMLVKGDVSPDKADHLSQHSRDIIKDFSGKRISFEGGEYTVKEEELYRSAVIYEKAMNFVERVHGLLKERLKDFDLEVSIDEGDRDTTVEDHIFVAEYLHRRGIDFWSLAPKFPGEFEKAVDYRGDIDKFTVELNKHCAVARMLGGYRLSLHSGSDKFSVYRIFNDATQHNFHIKTSGTSWLQALNVIHEKDRQLFKELYNIALDNLEESKKAYKISIYRQDFEEGLDLDNLHVLQNPKVKQLLHISYGVLLDEKRQEIYEVLNQHEAEHYRYVSDNIKKHLELLK

SEQ ID NO: 365 - protein, 483 aa, Thermoanaerobacter uzonensis
MKEELSNYLLKNSFLLYPDSFRRLKEDVYIFVAKKDSDKKIGFLTNGNFKLSSPHFLEDKYVEELGFYLNLYPLTYENYLILKDNFGISPVTCKEKTSFGTGDRLGLVTPAHIKVLKNYDIFPVLAQQSPRELVKTNRDFKDVLLKAILGVLEAGYAGGFGADADHIKDEKYLMEAIDAGYTMYTLDLSDLLVKISDMPESQLKEKAQSLSSQSREIIDRYKGKKFSISTDEDFVVSEDELYKSALTYEKAMKFVEKVYGILKDRLQHFDLEISIDEGEKDTTVEDHIFVVEYLHRKGIDFWSLAPKFPGEFQKAIDYKGDIKKFTSELKKHYFLTKELGGYKLSLHSGSDKFSIYKIFNEITEGNFHIKTSGTSWLQAISLIFEKDKDLFNDLYKIALDNLEESKKAYKVLIDRDDFPQTIQTEDSQILSKPEIKQLFHISYGVLLDERRKEIYEVLNKYEEEHYEFVSKNIKNHLKEIFNI

SEQ ID NO: 366 - protein, 533 aa, Lactobacillus ingluviei
MDLNGLLKDVEEILAKVDAGEKVESLSDAGVYVPSVQVDRRNVYFIYHTKDEKDHTVKTLVVYEENPTIGDFDALETLKGENSTLITAALTDHNNQALAKRFPWIKPTSRRNYKYTFGLGDRLGNASNAHLRLFKGTGIMPVLAQQSIRELTLMHRTNTDVLLSASWAVFEEGFTFGWGADGDHVKTEYEVDYAVKVGCSMITLDCTDVINNDAVTMSDEELDKTFNALDDDQKKYFNDTYLDKTFDLGNGNSVHFTKHDVEESVLTFYGAILFAADIYKKFVVPYNLDFEISMDETPYQTTNPNHFFFGNELHKRGIVPTTMAPRFYGEFQKAIDYIGDKDRFEREFVLHEAIAEYFGYKLSIHSGSDKLSVYEIIGRVAKNGWHVKTAGTNWLEALRVIAHKDPEFMVELYKYAYEHLDDVKDFYVFNAQTDGKAPKPENVTVDNVVDVLSDDDGRQVLHTMYGSLMNLKHNYHYVFRDKFWDILLKNQDLYDKYLNIHIAEHIDLLQGKYKTKEEALAALEPKTDISKEY

SEQ ID NO: 367 - protein, 390 aa, Petrotoga mexicana
MFTILPKKGISLGLGDRIGIATTGHIKVAKKYNFFPVFAQQSIRELNFTGRTFTDVRKDVLNALIEENYVGNSGFDGDHLKSDEEIQYALDSGITMLTLDCSEHMNKDSSIKDQIFEQFYNKSFFVNDMPIEYSDKNELNEIVSIYASVIERVIDVWNKFPKVNKKEVSFEVSVDETDVPTDEKTHFLISKYINDEGVKIDTLAPRFPGEFQKGIDYIGNVQEFKKSLIKQEKIAKYFGYRLSIHSGSDKFSIYPIIGEVTQGNYHLKTSGTSFLEAIKVVAQKDPEFFKKIWQTCLDKREEMDKYYHLSCNPFSVPKDLSPTEYLKNPDARQTLHVSYMFVLNPQYDFREKFFEILTKYQNEYHENVANHIEKHVKELKIEETIHKQKK

SEQ ID NO: 368 - protein, 386 aa, Defluviitoga tunisiensis
MFSKLPKQGISLGLGDRVGLATPGHIKVAKRHEFFPVFAQQSIRELNFTGRTFHDVKKDVENAVIKENYEGKSGFDGDHLKTDEEIKMAIDSGITMLTLDCSEYMGVVSKIKEKIYKGFYGKTFKVKDLDLEYSQEELEKILSIYSGVIERIIYIWNNFPKVKNKDVSFEVSIDETNIPTDEKTHFLLSKYLYDEGITIDTLAPRFPGEFQKGIDYIGNIKEFKNSLMKHHKIASYFGYRLSIHSGSDKFSIYPYVSQITQGNYHLKTSGTSYLQALKIIAQKAPDFFKEIWKTCLDKRTEMDKYYHLSCDPFSVPKDLKPIEYLNNPDARQTLHVSYMFVLNPKYDFRNRFFEILTKYENEYHIEVAEHIKRHVKELKIPEKIQN

SEQ ID NO: 369 - protein, 385 aa, Petrotoga miotherma
MFTILPKKGISLGLGDRIGIATPGHIKVAKKYNFFPVFAQQSIRELNFTGRTFTDVRKDVLNALVEENYVGNSGFDGDHLKSDEEIQYALDSGITMLTLDCSEHMNKDSSIKDQIFEQFYNKSFFVNDMPIEYSDKNELNKIVSIYASVIERVIDVWNKFPKVNKKEVTFEVSVDETDVPTDEKTHFLISKYIYDEGVKIDTLAPRFPGEFQKAIDYIGNIQEFKKSLIKQNKIAKYFGYRLSIHSGSDKFSIYPIIGEVTQGNYHLKTSGTSYLEAIKVVAQKDPEFFKKIWQTCLDKREEMDKYYHLSCDPFSVPKDLSPTEYLKNIDARQTLHVSYMFVLNPQYDFREKFFEILTKYQNEYYENVANHIEKHVKELKIEETK

SEQ ID NO: 370 - protein, 385 aa, Petrotoga olearia
MFTILPKKGISIGLGDRIGIATPGHIKVAKKYNFFPVFAQQSIRELNFTGRTFRDVRKDVLNALVEENYVGNSGFDGDHLKSDEEIQYALDSGITMLTLDCSEHMNKDSSVKESIFDQFYNKSFFVNDMPIEYSDKNELNKIVSIYGGVIERVIDVWNKFPKVNKKEVSFEVSVDETDVPTDEKTHFLISKYIYDEGVKIDTLAPRFPGEFQKGIDYIGNIQEFKKSLIKQDKIAKYFGYRLSIHSGSDKFSIYPIIGEVTQGNYHLKTSGTSYLEAIKVIAQKDPEFFKKIWQTCLDKREEMDKYYHLSCDPFSVPKDLSPTEYLQNPDARQTLHVSYMFVLNPQYDFRKKFFEILTKYQNEYHENVAHHIEKHVKELKVEETK

SEQ ID NO: 371 - protein, 418 aa, Thermophagus xiamenensis
MKKLAKYSFGMGDRFAHQASWQLKAITEIEKQGIEVTPVWNKSNREHTTIGSKPEDNRDAAQKAIQKAGWSKPWYIDADHINLDTVDNFLESSDFFTIDVASYIGKKGDSKEEETFISKMKPLIGNLNIPGVNSPFKITEQQLRNIAGQYLHAAFMAGETYKYIESVKGKGNFITEVSMDEVPEPQTPVELFFILAMLAHYGVPAQTIAPKFTGRFNKGVDYVGDIETFRKEYEANLMVIDYAIQKFGFPPELKLSIHSGSDKFSIYPVIKELSQKHNKGFHLKTAGTTWLEEVIGLAMAGGEALLFVKNIYSRALDNIEKLCAPYADVIDINTDNLPKLSEVNNWTGEEFANALRHVPDHPMYNPDLRQLIHVAYKLAAENINQFNSFLEQHSEIVGKCVFENLYKRHAERLFVFSN

SEQ ID NO: 372 - protein, 416 aa, Treponema caldarium
MKQLERFSMGIGDRFGHQGKAQLEALAEAKHLGCTIIPVWNKSYREHSIIHTEPGQVRKEADWAVAALGWQDPYHVDADHISMKTVDLFLDSSDFFTLDVADYTGKAADEASIARFVAKHQHCIGKLQIPGIEQPITITETTLTSVARKYLLAIQEAGKLYRHIANKKGPENFITEVSIDETDQPQGPEDLLFILAMIADEGIPAQTIAPKFTGRFNKGVDYVGNLTQFEREFNQDILVIAYASKEFGLPKNLKLSVHSGSDKFSIYPIIKKAIYTHHAGLHLKTAGTTWLEELIGLASAGDEGLRIVQQIYRETYYRFDELCAPYATVIDIHKDKLPEPNSVQAWNGETYAAALRHIENHPQYNPHFRQLLHVGYKVAAELGETYLKALEAHEHHIALQVKENLLDRHIRPIFIQ

SEQ ID NO: 373 - protein, 472 aa, Thermofilum uzonense
MLDTPRYLGKLPHLSVGVRLPEVFLEGIMSGFKTGNSAGGVMLSYHRETAPEYVINAPPGDFELTRGHTGTSIRHYIEASVAKAKEKGVVVEVEADHVSVSVSSEAVKRISGGGTHRVLSEEEVRSALKYIEDEIREAVSTRNIYFYTIDTCDLIDYSSEKIAVDELRTVFKDLYPASLIERYKDINVVVNGTRIRFDEEKVMRLSLKLMRSIDVSERIYRIIKEMTPWPFGIEIAFDETPVTSDPHELFFVLNELRTRGIPVDFIAPNVGFQKREDFTGDLETLHSRVKTLHEVASFFGSLLSFHSGSGSSPYSMKGKGVHDIIRRAAGGLFKYKISGVYFELLMQLMSRSDIPSVRRLYEEIYDAVIELLEDQVKRKGELYDEVLVKRLEEHRKKSLNGYVRDSESPVFRYYSFLALNIRRNGERYLRNAIVELYLEDKGFREQVDREISALTVAFLDSLGFRGNVRLLR

SEQ ID NO: 374 - protein, 408 aa, Artificial Sequence
  mutant D-fructose C4-epimerase
MWLSKDYLRKKGVYSITSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 375 - protein, 408 aa, Artificial Sequence
  mutant D-fructose C4-epimerase
MWLSKDYLRKKGVYSICNSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 376 - protein, 408 aa, Artificial Sequence
  mutant D-fructose C4-epimerase
MWLSKDYLRKKGVYSICASNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 377 - protein, 408 aa, Artificial Sequence
  mutant D-fructose C4-epimerase
MWLSKDYLRKKGVYSICSSNSYVIEASIEFAKEKGDYILIEATPHWVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 378 - protein, 408 aa, Artificial Sequence
  mutant D-fructose C4-epimerase
MWLSKDYLRKKGVYSICSSNSYVIEASIEFAKEKGDYILIEATPHRVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 379 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGPHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 380 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGAHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 381 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPGPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 382 - protein, 408 aa, Artificial Sequence
  mutant D-fructose C4-epimerase
MWLSKDYLRKKGVYSICSSNSYVIEASIEFAKEKGDYILIEATPQQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 383 - protein, 408 aa, Artificial Sequence
  mutant D-fructose C4-epimerase
MWLSKDYLRKKGVYSICSSNSYVIEASIEFAKEKGDYILIEATPAQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 384 - protein, 408 aa, Artificial Sequence
  mutant D-fructose C4-epimerase
MWLSKDYLRKKGVYSICSSNSYVIEASIEFAKEKGDYILIEATPKQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 385 - protein, 408 aa, Artificial Sequence
  mutant D-fructose C4-epimerase
MWLSKDYLRKKGVYSICSSNSYVIEASIEFAKEKGDYILIEATPHAVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 386 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGGHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 387 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPSPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 388 - protein, 408 aa, Artificial Sequence
  mutant D-fructose C4-epimerase
MWLSKDYLRKKGVYSICSSNSYVIEASIEFAKEKGDYILIEATPFQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 389 - protein, 408 aa, Artificial Sequence
  mutant D-fructose C4-epimerase
MWLSKDYLRKKGVYSICSSNSYVIEASIEFAKEKGDYILIEATPHSVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 390 - protein, 408 aa, Artificial Sequence
  mutant D-fructose C4-epimerase
MWLSKDYLRKKGVYSICSSNSYVIEASIEFAKEKGDYILIEATPHTVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 391 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWADEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 392 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWMDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 393 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWPDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 394 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWDDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 395 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCAMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 396 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWGDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 397 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKINIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 398 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIGIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 399 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIPIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 400 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDGSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 401 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDESMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 402 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDKSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 403 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKISIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 404 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCMMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 405 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCRMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 406 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCTMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 407 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSRPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 408 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSKPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 409 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGMDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 410 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGIDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 411 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGLDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 412 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTAVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 413 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTVVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 414 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTTVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 415 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTNVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 416 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDMPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 417 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDRPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 418 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPKAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 419 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIPGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 420 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPTAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 421 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPMAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 422 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGKEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 423 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEYEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 424 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGVEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 425 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEFEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 426 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGSGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 427 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGREEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 428 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEPVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 429 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFPIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 430 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFTIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 431 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIKLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 432 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVILLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 433 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIRLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 434 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSSDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 435 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIGYYWEYEDVKMVLNKLFENFSEGVDIKFIYQYFYDSYFDVREGKMKNDPRELIKKEIKRVLEDYSYAINL

SEQ ID NO: 436 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIAYYWEYEDVKMVLNKLFENFSEGVDIKFIYQYFYDSYFDVREGKMKNDPRELIKKEIKRVLEDYSYAINL

SEQ ID NO: 437 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRITYYWEYEDVKMVLNKLFENFSEGVDIKFIYQYFYDSYFDVREGKMKNDPRELIKKEIKRVLEDYSYAINL

SEQ ID NO: 438 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIEYYWEYEDVKMVLNKLFENFSEGVDIKFIYQYFYDSYFDVREGKMKNDPRELIKKEIKRVLEDYSYAINL

SEQ ID NO: 439 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRPYWEYEDVKMVLNKLFENFSEGVDIKFIYQYFYDSYFDVREGKMKNDPRELIKKEIKRVLEDYSYAINL

SEQ ID NO: 440 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRRYWEYEDVKMVLNKLFENFSEGVDIKFIYQYFYDSYFDVREGKMKNDPRELIKKEIKRVLEDYSYAINL

SEQ ID NO: 441 - protein, 408 aa, Artificial Sequence
  mutant D-fructose C4-epimerase
MWLSKDYLRKKGVYSICSSNSYVIEASIEFAKEKGDYILIEATPHQVNQFGGYSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRHYWEYEDVKMVLNKLFENFSEGVDIKFIYQYFYDSYFDVREGKMKNDPRELIKKEIKRVLEDYSYAINL

SEQ ID NO: 442 - protein, 408 aa, Artificial Sequence
  mutant D-fructose C4-epimerase
MWLSKDYLRKKGVYSICSSNSYVIEASIEFAKEKGDYILIEATPHQVNQFGGVSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 443 - protein, 408 aa, Artificial Sequence
  mutant D-fructose C4-epimerase
MWLSKDYLRKKGVYSICSSNSYVIEASIEFAKEKGDYILIEATPHQVNQFGGSSGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

SEQ ID NO: 444 - protein, 408 aa, Artificial Sequence
  mutant D-fructose C4-epimerase
MWLSKDYLRKKGVYSICSSNSYVIEASIEFAKEKGDYILIEATPHQVNQFGGASGMTPEDFKNFVMKIAKEKGLEEDKIILGGDHLGPLPWQDEPSPTAMNKAKDLIRAFVESGYKKIHIDCSMPLSDDPKVLPYEKIAERTRELFEIAEETARKYNFQPVYVVGTDVPIAGGGEEEGVTSVEDFRSAISSLKKYFNDVPNIWDRVVGFVIMLGIGFSYDKVFEYDRDKVRGILEEVKREDLFVEGHSTDYQARYALRNMVEDGVRILKVGPALTAAFRRGVFLLSNIEDEIIPERERSNIKRVILETMLRDDRYWRKYYKDSKRLELDIWYNLLDRIRYYWEYEDVKMVLNKLFENFSEGVDIKFIYQYFYDSYFDVREGKMKNDPRELIKKEIKRVLEDYSYAINL

The invention claimed is:

1. A modified polypeptide comprising one or more amino acid substitutions in an unmodified polypeptide, wherein the amino acid sequence of the unmodified polypeptide is SEQ ID NO:6 and wherein at least one substituted amino acid is at the amino acid residues corresponding to position H45, M212, or Y340,
wherein the modified polypeptide converts fructose to tagatose through epimerization at the carbon-4 position of fructose;
wherein the modified polypeptide is at least 85% identical to SEQ ID NO:6, and
wherein the modified polypeptide comprises H at position 85, D at position 121, H at position 247, D at position 250, and G at position 271.

2. The modified polypeptide of claim 1, wherein the modified polypeptide further comprises one or more amino acid substitutions at the amino acid residues corresponding to position M124, A171, E175, or V210.

3. The modified polypeptide of claim 1, wherein the polypeptide is immobilized to a carrier or support.

4. The modified polypeptide of claim 3, wherein the carrier or support is an organic composition.

5. The modified polypeptide of claim 4, wherein the organic composition is functionalized with a chemical group.

6. The modified polypeptide of claim 3, wherein the carrier or support is an inorganic composition.

7. A modified microorganism expressing the polypeptide of claim 1.

8. A method of producing tagatose, the method comprising:
(a) contacting fructose with the polypeptide of claim 1 or a microorganism expressing the polypeptide; and
(b) converting fructose to tagatose.

9. A method for producing a tagatose composition, comprising the steps of:
(a) providing a starting composition comprising greater than about 0.3%, about 0.5%, about 1%, about 2%, about 3%, about 4%, about 5%, about 10%, about 20%, about 30%, about 40%, about 50%, about 60%, about 70%, about 80%, about 90% of fructose by weight;
(b) contacting the starting composition with the polypeptide of claim 1 or a microorganism expressing the polypeptide; and
(c) producing a tagatose composition comprising tagatose.

10. The method of claim 9, wherein the tagatose composition comprises tagatose in an amount greater than about 0.1%, 0.2%, 0.3%, about 0.5%, about 1%, about 5%, about 10%, about 15%, about 20%, about 25%, about 30%, about 35%, or about 40%.

11. The method of claim 9, wherein the tagatose composition comprises tagatose in an amount between about 0.3-80 wt %.

12. The method of claim 9, wherein the starting composition comprises fructose in an amount between about 0.30% to about 70% by weight.

13. The method of claim 8, wherein the polypeptide or the microorganism expressing the polypeptide is immobilized to a carrier or support.

14. The method of claim 13, wherein the carrier or support is an organic composition.

15. The method of claim 14, wherein the organic composition is functionalized with a chemical group.

16. The method of claim 13, wherein the carrier or support is an inorganic composition.

17. The method of claim 8, wherein contacting fructose with the polypeptide or the microorganism expressing the polypeptide is performed at a temperature between about 40° C. and about 100° C.

18. The method of claim 8, wherein the contacting of fructose with the polypeptide or the microorganism expressing the polypeptide is performed at between about pH 4.5 and about pH 8.

19. The method of claim 8, wherein the contacting of fructose with the polypeptide or the microorganism expressing the polypeptide is performed in the presence of a metal ion.

20. The method of claim 19, wherein the metal ion is a divalent metal cation.

21. The method of claim 8, wherein the tagatose is isolated from the feed using a chromatographic method.

22. The method of claim 21, wherein the chromatic method is simulated moving bed chromatography.

23. The method of claim 8, wherein the tagatose product is crystallized.

24. The method of claim 23, wherein the crystallization is isothermal evaporative crystallization or evaporative cooling crystallization.

25. The method of claim 8, wherein the fructose is produced from glucose or sucrose.

26. The modified polypeptide of claim 1, wherein the amino acid residue corresponding to position H45 of SEQ ID NO:6 is substituted.

27. The modified polypeptide of claim 26, wherein the amino acid residue corresponding to position H45 of SEQ ID NO:6 is substituted with ALA, GLN, LYS, or PHE.

28. The modified polypeptide of claim 27, wherein the amino acid residue corresponding to position H45 of SEQ ID NO:6 is substituted with PHE.

29. The modified polypeptide of claim 1, wherein the amino acid residue corresponding to position M212 of SEQ ID NO:6 is substituted.

30. The modified polypeptide of claim 29, wherein the amino acid residue corresponding to position M212 of SEQ ID NO:6 is substituted with ARG, LEU, or LYS.

31. The modified polypeptide of claim 30, wherein the amino acid residue corresponding to position M212 of SEQ ID NO:6 is substituted with LEU.

32. The modified polypeptide of claim 30, wherein the amino acid residue corresponding to position M212 of SEQ ID NO:6 is substituted with ARG.

33. The modified polypeptide of claim 1, wherein the amino acid residue corresponding to position Y340 of SEQ ID NO:6 is substituted.

34. The modified polypeptide of claim 33, wherein the amino acid residue corresponding to position Y340 of SEQ ID NO:6 is substituted with ALA, ARG, HIS, PHE, or PRO.

35. The modified polypeptide of claim 34, wherein the amino acid residue corresponding to position Y340 of SEQ ID NO:6 is substituted with HIS.

36. The modified polypeptide of claim 34, wherein the amino acid residue corresponding to position Y340 of SEQ ID NO:6 is substituted with PRO.

37. The modified polypeptide of claim 2, wherein the amino acid residue corresponding to position M124 of SEQ ID NO:6 is substituted.

38. The modified polypeptide of claim 37, wherein the amino acid residue corresponding to position M124 of SEQ ID NO:6 is substituted with ARG or LYS.

39. The modified polypeptide of claim 38, wherein the amino acid residue corresponding to position M124 of SEQ ID NO:6 is substituted with ARG.

40. The modified polypeptide of claim 38, wherein the amino acid residue corresponding to position M124 of SEQ ID NO:6 is substituted with LYS.

41. The modified polypeptide of claim 2, wherein the amino acid residue corresponding to position A171 of SEQ ID NO:6 is substituted.

42. The modified polypeptide of claim 41, wherein the amino acid residue corresponding to position A171 of SEQ ID NO:6 is substituted with PRO.

43. The modified polypeptide of claim 2, wherein the amino acid residue corresponding to position E175 of SEQ ID NO:6 is substituted.

44. The modified polypeptide of claim 43, wherein the amino acid residue corresponding to position E175 of SEQ ID NO:6 is substituted with ARG, LYS, or VAL.

45. The modified polypeptide of claim 44, wherein the amino acid residue corresponding to position E175 of SEQ ID NO:6 is substituted with ARG.

46. The modified polypeptide of claim 44, wherein the amino acid residue corresponding to position E175 of SEQ ID NO:6 is substituted with LYS.

47. The modified polypeptide of claim 2, wherein the amino acid residue corresponding to position V210 of SEQ ID NO:6 is substituted.

48. The modified polypeptide of claim 47, wherein the amino acid residue corresponding to position V210 of SEQ ID NO:6 is substituted with PRO or THR.

49. The modified polypeptide of claim 48, wherein the amino acid residue corresponding to position V210 of SEQ ID NO:6 is substituted with THR.

50. The modified polypeptide of claim 1, wherein at least three amino acid substitutions are present in the unmodified polypeptide set forth in SEQ ID NO:6, and wherein the at least three substituted amino acid residues are at positions H45, M212, and Y340.

51. The modified polypeptide of claim 50, further comprising at least two additional amino acid substitutions at positions M124, A171, E175, and V210.

52. The modified polypeptide of claim 51, wherein all four amino acids at positions M124, A171, E175, and V210 are substituted.

\* \* \* \* \*